United States Patent 12,508,308 (INFLUENZA mRNA VACCINES) - sequence listing, part 7

SEQ ID NO: 33075 - RNA, 1701 nt, Artificial Sequence
  hemagglutinin__InfluenzaA__ACN43047
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggggucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33076 - RNA, 1701 nt, Artificial Sequence
  hemagglutinin__InfluenzaA__ACN43058
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcggcaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33077 - RNA, 1701 nt, Artificial Sequence; identical to SEQ ID NO: 33027
  hemagglutinin__InfluenzaA__ACN43069

SEQ ID NO: 33078 - RNA, 1701 nt, Artificial Sequence; identical to SEQ ID NO: 33061
  hemagglutinin__InfluenzaA__ACN43080

SEQ ID NO: 33079 - RNA, 1701 nt, Artificial Sequence
  hemagglutinin__InfluenzaA__ACN72617
auggaagcaaaauuguuuguauuauucugugcauucacugcauugaaagcugacaccauuuguguaggcuaucaugcuaacaauuccacagacacugucgacacaauacuggagaagaaugugacuguuacccauucaguuaauuuacuagaaaacagccacaaugggaaacucugcagccugaauggaaaggcccccuuacaacuggggaauugcaacguagcaggauggauccuuggcaacccagaaugugacuugcugcucacagcgaauucguggucuuacauaauagagacuucagauucaaaaaauggagcaugcuauccuggagaauuugcugauuaugaggaauuaagggagcagcugaguacaguuucuucauuugaaagauuugaaauuuucccaaaagcaaccucauggccaaaucaugagacaaccaaagguaccacaguugcaugcucccacucuggagccaacaguuuuuaucggaacuugcuauggauaguaaaaaagggaaacuccuauccuaagcucagcaagucauacacaaacaacaaaggaaaagaagugcuuguaaucuggggagugcaucacccuccgacugauagugaucaacaaacccucuaucagaauaagcacacauauguuucaguuggaucaucaaaauacuaccaaagguucaccccagaaauaguaaccagaccaaaagucagagagcaagcgggcagaaugaacuauuauuggacacuauuagaucaaggggacaccauaaccuuugaagccacggggaauuuaauagcaccauggcaugcauuugcauugaauaagggcucuaauucuggaauuaugaugucagaugcucauguucacaauugcacuacgaagugccaaacuccucauggggcuuugaaaggcaaucuuccuuuucagaauguacaucccaucacuauuggggaaugccccaaauauguuaaaagcacccaacuaagaauggcaacaggauuaaggaauauccccucuauucaauccagaggacuuuuuggggcaauugccggauucauugaaggaggauggacaggaaugauagauggaugguaugguuaucaucaucaaaaugagcagggaucugguuacgcagcagaucggaaaaguacacaaaucgcaauugaugggaucagcaacaaaguaaacucaguaauugaaaaaaugaacauucaauuuacuucagugggcaaagaguucaauaaucuagagaaaaggauugagaauuugaauaaaaaggucgaugauggauuuuuggauguauggacuuauaacgcugaauuacucauccugcucgagaacgaaagaacccuagauuuccaugacuuuaacgugaaaaauuuauaugaaaaggucaaaucacaacugagaaacaaugccaaggaaaucgguaaugguuguuuugaguucuaucacaaaugugauaaugaaugcauggaaagcguaaagaauggcacauauaauuaucccagauauucagaagaauccaaauugaauagagaggaaauagacgguguaaaauuagaaucagugggaguucaucagauuuuggcgaucuacuccacagucgccaguucccugguauugcuagucucccugggggcaaucagcuucuggaugugcucuaaugggucauugcaaugcagaauaugcauuuaa

SEQ ID NO: 33080 - RNA, 1701 nt, Artificial Sequence
  hemagglutinin__InfluenzaA__ACN72632
augaagacugucauugcuuuaagcuacgucuuuugucugguuuuuggccaagaucuuccaggaaagggcaacaacacagcaacacugugccugggacaucaugcagugccaaauggaacacuagugaaaacaaucacagaugaucagaucgaaguaaccaaugcuacagaacugguccaaaauuucucaauagguaaaauaugcaagaauccucaucgaauucuugauggggcaaauugcacacugauagacucucuauugggggacccucacugugaugguuuucaaaaugagaaaugggaccuuuucauugaacgcagcaaggcuuucagcaacuguuacccuuaugaugugccggaguauaccucucuuaggucacuaauugccucgucaggcaccuuggaauuuaccaaugaagauuucaauuggacugggguuacccagaauggaggaagcagugcuugcaagagggggccuaacaacagcuuuuucaguaggcugaacugguuguacaaaucagguaacacauauccgaugcuaaauguuacuaugccaaacagugaugauuuugacaaauuguacauuugggggguucaucauccgaguaccgauagagaacagaccaaccuguauauucaagcaucagggaaaauaauagucuccacaaagagaagucaacaaaccauaaucccgaauaucgggucuagacccuggguaagggguuugucuaguaggauaagcaucuacuggacaauaguuaaaccaggagacauccugauaaucaacagcaauggaaaccuaauugcuccucgggguuacuucaaaauacagacugggaaaagcucaguaaugagaucagaugcaccuauuggcaccugcaauuaugaaugcauuacuccaaacggaagcauacccaaugacaagcccuuucaaaacguaaacaggaucacauauggggcaugcccccauuacaucaagcaaaacacucugaaguuagcaacagggaugcggaauauaccagaaagacaaacuagagguauauucggugcaauagcaggguucauagagaaugguugggaaggaauggugaacgguugguacgguuucaggcaccaaaauucugagggcauaggacaggcagcagaucuuaaaaguacccaagcagcuaucaaccaaaucaauggaaaacugaauagaguaaucgagaagacgaacgagaaauuccaucaaaucgaaaaggaguucucagaaguagaaggaagaauccaagaccucgaaagauauguugaagauacuaagauagaucuuuggucuuacaacgcggaacuucuugucgcacuagagaaucaacacacaauugaccugacugacucagaaaugaacaaacucuuugaaaaaacaagaaaacaacuaagggaaaaugcugaggacaugggaaaugguugcuucaaaauauaccacaaaugugacaacucuugcauggagucaaucagaaauggaacuuacgaccauaacgaauacagagacgaagcaguaaacaaucgauuucagaucaaaaguguugagcugaagucaggauacaaagacuggauccuguggauuuccuuugccauaucaugcuuuuugcuuugugcuguuuggcugggauucauaauaugggccugccagaaaggcaacauuaggugcaacauuugcaucuga

SEQ ID NO: 33081 - RNA, 1701 nt, Artificial Sequence
  hemagglutinin__InfluenzaA__ACN76478
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucauuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuuuauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33082 - RNA, 1701 nt, Artificial Sequence
  hemagglutinin__InfluenzaA__ACN76489
augaagacuaucauugcuuugggcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacggcuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33083 - RNA, 1701 nt, Artificial Sequence
  hemagglutinin__InfluenzaA__ACN76500
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauucgacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33084 - RNA, 1701 nt, Artificial Sequence; identical to SEQ ID NO: 33045
  hemagglutinin__InfluenzaA__ACN76511

SEQ ID NO: 33085 - RNA, 1701 nt, Artificial Sequence; identical to SEQ ID NO: 33021
  hemagglutinin__InfluenzaA__ACN76522

SEQ ID NO: 33086 - RNA, 1701 nt, Artificial Sequence; identical to SEQ ID NO: 32938
  hemagglutinin__InfluenzaA__ACO36331

SEQ ID NO: 33087 - RNA, 1701 nt, Artificial Sequence
  hemagglutinin__InfluenzaA__ACO36342
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccaagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaaucgaagggagaauucaggaccuugagaaauauguugaggacaccaagauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcuuuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33088 - RNA, 1701 nt, Artificial Sequence
  hemagglutinin__InfluenzaA__ACO36364
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33089 - RNA, 1701 nt, Artificial Sequence; identical to SEQ ID NO: 32806
  hemagglutinin__InfluenzaA__ACO36375

SEQ ID NO: 33090 - RNA, 1698 nt, Artificial Sequence
  hemagglutinin__InfluenzaA__ACO36397
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaguaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaaucuagagguuuguuuggagccauugccgguuucauugaagggggauggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagccgugggcaaagaauucaacaaauuggaaagaaggauggaaaacuugaauaaaaaaguugaugauggguuuauagacaucuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucuaaguuaaacagggagaaaauugauggagugaaauuggaaucaaugggagucuaucagauuuuggcgaucuacucaacagucgccaguucucugguucuuuuggucucccugggggcaaucagcuucuggauguguuccaaugggucuuugcaguguagaauaugcaucuaa

SEQ ID NO: 33091 - RNA, 1701 nt, Artificial Sequence; identical to SEQ ID NO: 32805
  hemagglutinin__InfluenzaA__ACO36408

SEQ ID NO: 33092 - RNA, 1701 nt, Artificial Sequence; identical to SEQ ID NO: 32808
  hemagglutinin__InfluenzaA__ACO36419

SEQ ID NO: 33093 - RNA, 1701 nt, Artificial Sequence; identical to SEQ ID NO: 32808
  hemagglutinin__InfluenzaA__ACO36430

SEQ ID NO: 33094 - RNA, 1701 nt, Artificial Sequence
  hemagglutinin__InfluenzaA__ACO36441
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauugaacaaccgguuccagaucaaagguguugagcugaagucuggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 33095 - RNA, 1701 nt, Artificial Sequence
  hemagglutinin__InfluenzaA__ACO36452
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacaaucucuaccaaaagaagccaacaaacuguaaucccgaauaucggaucuagacccaggguaagggaugucuccagccggauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33096 - RNA, 1701 nt, Artificial Sequence
  hemagglutinin__InfluenzaA__ACO36463
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugccaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaaacaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagagacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuugugcuuuguguugcuuuguugggguucaucaugugggccugccaaaaaggcaacauuaggugcaacauuugcauuuga

SEQ ID NO: 33097 - RNA, 1701 nt, Artificial Sequence
  hemagglutinin__InfluenzaA__ACO36474
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaagauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccagaguaagggaugucuccagccggauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggacugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33098 - RNA, 1701 nt, Artificial Sequence
  hemagglutinin__InfluenzaA__ACO36496
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacgguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcccaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33099 - RNA, 1701 nt, Artificial Sequence
  hemagglutinin__InfluenzaA__ACO36518
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaaguucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguucccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauaugggaccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauagggucaaucagaaauggaacuuaugaccaugauguauacagagaugaagcauuaaacaaccgguuccagaucaaagguguugagcugaaguuaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33100 - RNA, 1701 nt, Artificial Sequence
  hemagglutinin__InfluenzaA__ACO36551
augaagacuaucauugcuuugagccacauucuaugucugguuuucgcucaaaaaccucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33101 - RNA, 1701 nt, Artificial Sequence
  hemagglutinin__InfluenzaA__ACO36562
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguagccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33102 - RNA, 1701 nt, Artificial Sequence
  hemagglutinin__InfluenzaA__ACO36573
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33103 - RNA, 1701 nt, Artificial Sequence
  hemagglutinin__InfluenzaA__ACO36584
augaagacuaucauugcuuugagcuacauucuaugucugguuuucucucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaaaaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcaggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33104 - RNA, 1701 nt, Artificial Sequence
  hemagglutinin__InfluenzaA__ACO36595
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggaacuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33105 - RNA, 1701 nt, Artificial Sequence
  hemagglutinin__InfluenzaA__ACO36606
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaaaaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuacccaaagaagccaacaaacuguaaucccgaauaucggaucuaggcccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguggagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33106 - RNA, 1701 nt, Artificial Sequence
  hemagglutinin__InfluenzaA__ACO36617
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucgggucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaaguauucccaaugacaaaccauuucaaaauguaaacagaaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33107 - RNA, 1701 nt, Artificial Sequence
  hemagglutinin__InfluenzaA__ACO36628
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 33108 - RNA, 1701 nt, Artificial Sequence
  hemagglutinin__InfluenzaA__ACO36639
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguuuugcuuuguugggguucaucaugugggccugccaaaaaggcaacauuaggugcaacauuugcauuuga

SEQ ID NO: 33109 - RNA, 1701 nt, Artificial Sequence
  hemagglutinin__InfluenzaA__ACO36661
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaaguuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacauuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33110 - RNA, 1701 nt, Artificial Sequence
  hemagglutinin__InfluenzaA__ACO36683
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugugacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaucaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33111 - RNA, 1701 nt, Artificial Sequence
  hemagglutinin__InfluenzaA__ACO37122
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaccagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguagccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33112 - RNA, 1701 nt, Artificial Sequence
  hemagglutinin__InfluenzaA__ACO94514
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33113 - RNA, 1701 nt, Artificial Sequence
  hemagglutinin__InfluenzaA__ACO94515
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33114 - RNA, 1701 nt, Artificial Sequence
  hemagglutinin__InfluenzaA__ACO94516
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggaccggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaacucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33115 - RNA, 1701 nt, Artificial Sequence; identical to SEQ ID NO: 33027
  hemagglutinin__InfluenzaA__ACO94672

SEQ ID NO: 33116 - RNA, 1701 nt, Artificial Sequence
  hemagglutinin__InfluenzaA__ACO94683
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagauccaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucacagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33117 - RNA, 1701 nt, Artificial Sequence; identical to SEQ ID NO: 33027
  hemagglutinin__InfluenzaA__ACO94694

SEQ ID NO: 33118 - RNA, 1698 nt, Artificial Sequence
  hemagglutinin__InfluenzaA__ACO94705
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagccacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33119 - RNA, 1701 nt, Artificial Sequence
  hemagglutinin__InfluenzaA__ACO94727
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugggacuuaugaccacgauguauacagagaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaaaggcaacauuaggugcaacauuugcauuuga

SEQ ID NO: 33120 - RNA, 1701 nt, Artificial Sequence
  hemagglutinin__InfluenzaA__ACO94738
augaagacuaucauugcuuugagcuacauucaaugucugguuuucgcucaaaaauuuccuggaaaugacaacagcacggcaacgcugugccuugggcaccaugcaguaccaaacggaacgguagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccucaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucgagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcucccagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggagccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33121 - RNA, 1701 nt, Artificial Sequence
  hemagglutinin__InfluenzaA__ACO94760
augaagacuaucauugcuuugagcuacauucuaugucugguuuucgcucaaaaauuuccuggaaaugacaacagcacggcgacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaaugugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugaaggaauaggacaagcagcagaucucaaaagcacucaagcagcaaucgaucaaaucaaugggaagcugaauagguugaucgggaaaaccaacgagaaauuccaucagauugagaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33122 - RNA, 1701 nt, Artificial Sequence
  hemagglutinin__InfluenzaA__ACO94771
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucaugucuuuugcuuuguguugcuuuguugggguucaucaugugggccugccaaaaaggcaacauuaggugcaacauuugcauuuga

SEQ ID NO: 33123 - RNA, 1701 nt, Artificial Sequence; identical to SEQ ID NO: 33027
  hemagglutinin__InfluenzaA__ACO94782

SEQ ID NO: 33124 - RNA, 1701 nt, Artificial Sequence; identical to SEQ ID NO: 33055
  hemagglutinin__InfluenzaA__ACO94793

SEQ ID NO: 33125 - RNA, 1698 nt, Artificial Sequence
  hemagglutinin__InfluenzaA__ACO94804
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauagguaaccaaagggcucucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauggaugugaugcgaagugccaaacaccucagggagcuauaaacagcagucuuccuuuccagaauguacacccugucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccuaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33126 - RNA, 1701 nt, Artificial Sequence; identical to SEQ ID NO: 32806
  hemagglutinin__InfluenzaA__ACO94815

SEQ ID NO: 33127 - RNA, 1701 nt, Artificial Sequence
  hemagglutinin__InfluenzaA__ACO94848
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaacuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33128 - RNA, 1698 nt, Artificial Sequence
  hemagglutinin__InfluenzaA__ACO94859
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagccacaauggaaaacuaugucuauuaaaaggaauagccccacuacaauuggguaauugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuauuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccggauucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaagaauggaaaacuugaacaaaaaaguugaugauggguuuauagacauuuggaccuacaaugcagaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaaugaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33129 - RNA, 1698 nt, Artificial Sequence
  hemagglutinin__InfluenzaA__ACO94870
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaauagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33130 - RNA, 1701 nt, Artificial Sequence
  hemagglutinin__InfluenzaA__ACO94881
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccggauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacagaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33131 - RNA, 1701 nt, Artificial Sequence
  hemagglutinin__InfluenzaA__ACO94892
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugccaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaaacaucaggaagaaucacaaucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauugucaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagagacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 33132 - RNA, 1701 nt, Artificial Sequence
  hemagglutinin__InfluenzaA__ACO94903
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcgaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuucaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33133 - RNA, 1701 nt, Artificial Sequence
  hemagglutinin__InfluenzaA__ACO94925
augaagacuaucauugcuuugagcuacauucuaugucugguuuucgcccaaaaacuucccggaaaugacaacagcacggcaacgcugugccuugggcaccaugcagugccaaacggaacgguagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaccuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauuuuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33134 - RNA, 1701 nt, Artificial Sequence
  hemagglutinin__InfluenzaA__ACO94936
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaagacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccggauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33135 - RNA, 1701 nt, Artificial Sequence
  hemagglutinin__InfluenzaA__ACO94947
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucagaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauauggguaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33136 - RNA, 1701 nt, Artificial Sequence
  hemagglutinin__InfluenzaA__ACO95153
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaacuuugacaaauuguacauuugggggguucaccacccggguacggacaaugaccaaaucagccuauaugcccaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33137 - RNA, 1701 nt, Artificial Sequence
  hemagglutinin__InfluenzaA__ACO95171
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguagccucauccggcacacuggaguuuaacaaugaaaguuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33138 - RNA, 1701 nt, Artificial Sequence
  hemagglutinin__InfluenzaA__ACO95193
augaagacuaucauugcuuugagcuacauucuaugucugguuuucgcucaaaaacuucccggaaaugacaaaagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaacuucaauuggacuggagucacucagaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcccaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaguucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 33139 - RNA, 1701 nt, Artificial Sequence
  hemagglutinin__InfluenzaA__ACO95204
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguagccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgauuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33140 - RNA, 1701 nt, Artificial Sequence
  hemagglutinin__InfluenzaA__ACO95215
augaagacuaucauugcuuugagcuacauucuaugucuaguuuuugcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaaaguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33141 - RNA, 1701 nt, Artificial Sequence
  hemagglutinin__InfluenzaA__ACO95226
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaacuguacauuugggggguucaccacccggguacggacaaugaccaaaucagccuauaugcucaagcaucaggaagaaucacagucucuaccaaaagaagccaacaaacuguaaucccgaguaucggaucuagacccaggauaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaacucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguggcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33142 - RNA, 1701 nt, Artificial Sequence
  hemagglutinin__InfluenzaA__ACO95248
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuaggcccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguggagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33143 - RNA, 1701 nt, Artificial Sequence
  hemagglutinin__InfluenzaA__ACO95270
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaauaaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33144 - RNA, 1701 nt, Artificial Sequence; identical to SEQ ID NO: 33027
  hemagglutinin__InfluenzaA__ACO95281

SEQ ID NO: 33145 - RNA, 1701 nt, Artificial Sequence
  hemagglutinin__InfluenzaA__ACO95292
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33146 - RNA, 1701 nt, Artificial Sequence; identical to SEQ ID NO: 33061
  hemagglutinin__InfluenzaA__ACO95303

SEQ ID NO: 33147 - RNA, 1698 nt, Artificial Sequence
  hemagglutinin__InfluenzaA__ACO95382
augaaaguaaaacuacugguccuguuaugcacauuuacagcuacauaugcagacacaauauguauaggcuaccaugcuaacaacucgaccgacacuguugacacaguacuugaaaagaauguaacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaggcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaagagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacugggaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 33148 - RNA, 1698 nt, Artificial Sequence
  hemagglutinin__InfluenzaA__ACO95415
augaaaguaaaacuacugguccuguuaugcacauuuacagcuacauaugcggacacaauauguauaggcuaccaugcuaacaacucgaccgacacuauugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33149 - RNA, 1701 nt, Artificial Sequence
  hemagglutinin__InfluenzaA__ACO95426
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaauugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucuucuugcaaaaggagaucuaauaacaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccggauaagcaucuauuggacaauaguaaaaccgggagacauacuuuugauuaacagcacagggaaucuaauagcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauagggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33150 - RNA, 1701 nt, Artificial Sequence
  hemagglutinin__InfluenzaA__ACO95437
augaagacuaucauugcuuugagcuacauucuaugucugguuuucgcucaaaaacuucccggaaaugacaacagcacggcaacgcugugccuugggcaccaugcaguaccaaacgggacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33151 - RNA, 1701 nt, Artificial Sequence
  hemagglutinin__InfluenzaA__ACO95448
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucaaccuauaugcucaagcaucaggaagaaucacagucucuaccaaaagaagccaacaaacuguaaucccgaauaucggaucuagacccaggguaagggauauccccagcagaauaagcaucuacuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33152 - RNA, 1701 nt, Artificial Sequence; identical to SEQ ID NO: 31139
  hemagglutinin__InfluenzaA__ACO95459

SEQ ID NO: 33153 - RNA, 1701 nt, Artificial Sequence
  hemagglutinin__InfluenzaA__ACO95470
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcagaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33154 - RNA, 1701 nt, Artificial Sequence
  hemagglutinin__InfluenzaA__ACO95481
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauuuaccagagaaacaaacuagaggcauauuuggcgcaaucgcggguuucauagaaaaugguugggagggaaugguggaugguugguacgguuucaggcaucaaaauucugagggaauuggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33155 - RNA, 1701 nt, Artificial Sequence
  hemagglutinin__InfluenzaA__ACO95492
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggugacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33156 - RNA, 1701 nt, Artificial Sequence; identical to SEQ ID NO: 33155
  hemagglutinin__InfluenzaA__ACO95503

SEQ ID NO: 33157 - RNA, 1701 nt, Artificial Sequence
  hemagglutinin__InfluenzaA__ACO95514
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33158 - RNA, 1701 nt, Artificial Sequence
  hemagglutinin__InfluenzaA__ACO95536
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacagcuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33159 - RNA, 1701 nt, Artificial Sequence
  hemagglutinin__InfluenzaA__ACO95547
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugccacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33160 - RNA, 1701 nt, Artificial Sequence
  hemagglutinin__InfluenzaA__ACP41963
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33161 - RNA, 1698 nt, Artificial Sequence
  hemagglutinin__InfluenzaA__ACP44192
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaggcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaagagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacugggaugguagaugguugguaugguuaucaucaucagaaugagcaaggaucuggcuaugcugcagaucaaaaaagcacacaaaaugccauuaaugggauuacaaacaaggugaauucuguuauugagaaaaugaacacucaauucacagcagugggcaaagaauucaacaaauuggaaagaaggauggaaaacuugaauaaaaagguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 33162 - RNA, 1698 nt, Artificial Sequence; identical to SEQ ID NO: 33147
  hemagglutinin__InfluenzaA__ACP44203

SEQ ID NO: 33163 - RNA, 1698 nt, Artificial Sequence
  hemagglutinin__InfluenzaA__ACP44225
augaaaguaaaacuacugguccuguuaugcacauuuacagcuacauaugcagacacaauauguauaggcuaccaugcuaacaacucaaccgacacuguugacacaguacuugaaaagaaugugacagugacacauucugucaaccugcuugagaacagucacaauggaaaacuaugucuauuaaaaggaauagccccacuacaauuggguaauugcagcguugccggauggaucuuaggaaacccagaaugcggauugcugauuuccaaggagucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccaaagaaucaaaguuaaacagggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33164 - RNA, 1701 nt, Artificial Sequence
  hemagglutinin__InfluenzaA__ACP44236
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucugauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauagugaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33165 - RNA, 1701 nt, Artificial Sequence; identical to SEQ ID NO: 33101
  hemagglutinin__InfluenzaA__ACP44247

SEQ ID NO: 33166 - RNA, 1701 nt, Artificial Sequence
  hemagglutinin__InfluenzaA__ACP44258
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguaugguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33167 - RNA, 1701 nt, Artificial Sequence
  hemagglutinin__InfluenzaA__ACP44269
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauagcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33168 - RNA, 1701 nt, Artificial Sequence
  hemagglutinin__InfluenzaA__ACQ44554
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33169 - RNA, 1701 nt, Artificial Sequence; identical to SEQ ID NO: 33168
  hemagglutinin__InfluenzaA__ACQ44556

SEQ ID NO: 33170 - RNA, 1701 nt, Artificial Sequence; identical to SEQ ID NO: 33168
  hemagglutinin__InfluenzaA__ACQ45338

SEQ ID NO: 33171 - RNA, 1701 nt, Artificial Sequence
  hemagglutinin__InfluenzaA__ACQ55359
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33172 - RNA, 1701 nt, Artificial Sequence; identical to SEQ ID NO: 33160
  hemagglutinin__InfluenzaA__ACQ55361

SEQ ID NO: 33173 - RNA, 1701 nt, Artificial Sequence
  hemagglutinin__InfluenzaA__ACQ63223
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33174 - RNA, 1701 nt, Artificial Sequence; identical to SEQ ID NO: 33173
  hemagglutinin__InfluenzaA__ACQ63239

SEQ ID NO: 33175 - RNA, 1701 nt, Artificial Sequence
  hemagglutinin__InfluenzaA__ACQ63244
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33176 - RNA, 1701 nt, Artificial Sequence; identical to SEQ ID NO: 33173
  hemagglutinin__InfluenzaA__ACQ63257

SEQ ID NO: 33177 - RNA, 1701 nt, Artificial Sequence
  hemagglutinin__InfluenzaA__ACQ65691
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucuucuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaagggauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuuaccauaucauguuuuuugcuuuguguugcuuuguugggguucaucaugugggccugccaaaaaggcaacauuaggugcaacauuugcauuuaa

SEQ ID NO: 33178 - RNA, 1701 nt, Artificial Sequence; identical to SEQ ID NO: 33027
  hemagglutinin__InfluenzaA__ACQ65713

SEQ ID NO: 33179 - RNA, 1701 nt, Artificial Sequence
  hemagglutinin__InfluenzaA__ACQ65724
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuucuuuugccauaucauguuuuuugcuuuguguugcuuuguugggguucaucaugugggccugccaaaaaggcaacauuaggugcaacauuugcauuuga

SEQ ID NO: 33180 - RNA, 1701 nt, Artificial Sequence
  hemagglutinin__InfluenzaA__ACQ65747
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaacuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaauaggacaagcagcagaucucaaaagcacucaagcagcaaucgaucaaaucaaugggaagcugaauggguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33181 - RNA, 1698 nt, Artificial Sequence
  hemagglutinin__InfluenzaA__ACQ65758
augaaaguaaaacuacugguccuguuaugcacauuuacagcuacauacgcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacguuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacuuaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33182 - RNA, 1701 nt, Artificial Sequence; identical to SEQ ID NO: 33168
  hemagglutinin__InfluenzaA__ACQ73386

SEQ ID NO: 33183 - RNA, 1701 nt, Artificial Sequence; identical to SEQ ID NO: 33173
  hemagglutinin__InfluenzaA__ACQ73387

SEQ ID NO: 33184 - RNA, 1701 nt, Artificial Sequence
  hemagglutinin__InfluenzaA__ACQ73555
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaagccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaguauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33185 - RNA, 1701 nt, Artificial Sequence; identical to SEQ ID NO: 33173
  hemagglutinin__InfluenzaA__ACQ76294

SEQ ID NO: 33186 - RNA, 1701 nt, Artificial Sequence; identical to SEQ ID NO: 33173
  hemagglutinin__InfluenzaA__ACQ76314

SEQ ID NO: 33187 - RNA, 1701 nt, Artificial Sequence; identical to SEQ ID NO: 33173
  hemagglutinin__InfluenzaA__ACQ76317

SEQ ID NO: 33188 - RNA, 1701 nt, Artificial Sequence
  hemagglutinin__InfluenzaA__ACQ76318
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33189 - RNA, 1701 nt, Artificial Sequence; identical to SEQ ID NO: 33160
  hemagglutinin__InfluenzaA__ACQ76326

SEQ ID NO: 33190 - RNA, 1701 nt, Artificial Sequence; identical to SEQ ID NO: 33160
  hemagglutinin__InfluenzaA__ACQ76336

SEQ ID NO: 33191 - RNA, 1701 nt, Artificial Sequence; identical to SEQ ID NO: 33168
  hemagglutinin__InfluenzaA__ACQ76347

SEQ ID NO: 33192 - RNA, 1701 nt, Artificial Sequence; identical to SEQ ID NO: 33173
  hemagglutinin__InfluenzaA__ACQ76365

SEQ ID NO: 33193 - RNA, 1701 nt, Artificial Sequence; identical to SEQ ID NO: 33173
  hemagglutinin__InfluenzaA__ACQ76370

SEQ ID NO: 33194 - RNA, 1701 nt, Artificial Sequence
  hemagglutinin__InfluenzaA__ACQ76376
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33195 - RNA, 1701 nt, Artificial Sequence
  hemagglutinin__InfluenzaA__ACQ76383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33196 - RNA, 1701 nt, Artificial Sequence; identical to SEQ ID NO: 33173
  hemagglutinin__InfluenzaA__ACQ76389

SEQ ID NO: 33197 - RNA, 1701 nt, Artificial Sequence
  hemagglutinin__InfluenzaA__ACQ76401
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33198 - RNA, 1701 nt, Artificial Sequence; identical to SEQ ID NO: 33173
  hemagglutinin__InfluenzaA__ACQ76405

SEQ ID NO: 33199 - RNA, 1701 nt, Artificial Sequence
  hemagglutinin__InfluenzaA__ACQ76408
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33200 - RNA, 1701 nt, Artificial Sequence
  hemagglutinin__InfluenzaA__ACQ77601
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcgacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuagaaaacagauauccagcaccgaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 33201 - RNA, 1701 nt, Artificial Sequence
  hemagglutinin__InfluenzaA__ACQ83310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguuaaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33202 - RNA, 1701 nt, Artificial Sequence
  hemagglutinin__InfluenzaA__ACQ84451
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaggauauguauuuaa

SEQ ID NO: 33203 - RNA, 1701 nt, Artificial Sequence; identical to SEQ ID NO: 33168
  hemagglutinin__InfluenzaA__ACQ84457

SEQ ID NO: 33204 - RNA, 1701 nt, Artificial Sequence
  hemagglutinin__InfluenzaA__ACQ84477
augaaggcaauacuauuagucuugcuauauacauucacagccgcaaaugcagacacauuauguauagguuaucaugcaaauaauucaacugacacuguugauacaguacuagaaaagaauguaacaguaacacacucuguuaaccuucuagaagacagacauaacggaaaacuauguaaacuaagggggguggccccauugcauuuggguaaauguaacauugcuggauggcuccugggaaacccagaaugugaauuacuauucacagcaagcucauggucuuacauuguggaaacaucuaacucagacaaugggacauguuacccaggagauuucaucaauuaugaagagcuaagagagcaguugagcucagugucaucauuugaaagguuugagauauuccccaaggcaaguucauggcccgaucaugaaacgaacagaggugugacggcagcauguccuuaugcuggagcaaacagcuucuacagaaauuuaauauggcugguaaaaaaaggaaauucauacccaaagcucagcaaauccuauguuaacaauaaggagaaggaaguccucgugcuauggggcauucaccauccaccuaccaguacugaccaacaaagucucuaccagaaugcagaugccuauguuuuuguggggucaucaaaguacaacaagaaauucaagccagagauagcaacaagacccaaggugagaggucaagcagggagaaugaacuauuacuggacacuaguugagccuggagacacaauaacauucgaagcaacuggaaaucuaguggugccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaaguacaaaauugagaauggcuacaggauuaaggaauaucccgucuauucaaucuagaggucuguuuggagccauugcuggcuuuauugaggggggauggacaggaaugauagauggaugguacgguuaucaccaucaaaaugagcagggaucaggauaugcagccgaccaaaagagcacacagaaugccauugacgggaucacuaacaaaguaaacucuguuauugaaaagaugaacacacaauucacagcaguggguaaagaauucaaccaccuggaaaaaagaauagagaauuuaaauaaaaagguugaugaugguuuucuggauguuuggacuuacaaugccgaauuguugguucuauuggaaaaugaaagaacuuuggauuaccaugacucaaaugugaagaaccuauaugagaagguaagaagccagcuaaaaaacaaugccaaggaaauuggaaauggcugcuuugaauuuuaccacaaaugugaugacacgugcauggagagcgucaaaaaugggacuuaugauuaccccaaauacucagaagaaucaaaacuaaacagagaggaaauagauggaguaaagcuggaaucaacaaggauuuaccagauuuuggcgaucuauucaacugucgccaguucauugguacuguuagucucccugggggcaaucaguuucuggaugugcuccaaugggucuuuacagugcagaauauguauuuaa

SEQ ID NO: 33205 - RNA, 1701 nt, Artificial Sequence
  hemagglutinin__InfluenzaA__ACQ89900
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugggucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuguugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33206 - RNA, 1701 nt, Artificial Sequence
  hemagglutinin__InfluenzaA__ACQ89902
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33207 - RNA, 1701 nt, Artificial Sequence
  hemagglutinin__InfluenzaA__ACQ89904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaagggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33208 - RNA, 1701 nt, Artificial Sequence; identical to SEQ ID NO: 33205
  hemagglutinin__InfluenzaA__ACQ89905

SEQ ID NO: 33209 - RNA, 1701 nt, Artificial Sequence
  hemagglutinin__InfluenzaA__ACQ99607
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33210 - RNA, 1701 nt, Artificial Sequence; identical to SEQ ID NO: 33197
  hemagglutinin__InfluenzaA__ACQ99608

SEQ ID NO: 33211 - RNA, 1701 nt, Artificial Sequence; identical to SEQ ID NO: 33197
  hemagglutinin__InfluenzaA__ACQ99609

SEQ ID NO: 33212 - RNA, 1701 nt, Artificial Sequence; identical to SEQ ID NO: 33209
  hemagglutinin__InfluenzaA__ACQ99611

SEQ ID NO: 33213 - RNA, 1701 nt, Artificial Sequence
  hemagglutinin__InfluenzaA__ACQ99614
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggagcaaucaguuucuggaugugcucuaaugggucucuacaguguagaauauguauuuaa

SEQ ID NO: 33214 - RNA, 1701 nt, Artificial Sequence; identical to SEQ ID NO: 33213
  hemagglutinin__InfluenzaA__ACQ99616

SEQ ID NO: 33215 - RNA, 1701 nt, Artificial Sequence; identical to SEQ ID NO: 33197
  hemagglutinin__InfluenzaA__ACQ99617

SEQ ID NO: 33216 - RNA, 1701 nt, Artificial Sequence; identical to SEQ ID NO: 33197
  hemagglutinin__InfluenzaA__ACQ99618

SEQ ID NO: 33217 - RNA, 1701 nt, Artificial Sequence; identical to SEQ ID NO: 33197
  hemagglutinin__InfluenzaA__ACQ99619

SEQ ID NO: 33218 - RNA, 1701 nt, Artificial Sequence; identical to SEQ ID NO: 33197
  hemagglutinin__InfluenzaA__ACQ99620

SEQ ID NO: 33219 - RNA, 1701 nt, Artificial Sequence; identical to SEQ ID NO: 33213
  hemagglutinin__InfluenzaA__ACQ99621

SEQ ID NO: 33220 - RNA, 1701 nt, Artificial Sequence; identical to SEQ ID NO: 33168
  hemagglutinin__InfluenzaA__ACQ99622

SEQ ID NO: 33221 - RNA, 1701 nt, Artificial Sequence
  hemagglutinin__InfluenzaA__ACR01014
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucguuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauggagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33222 - RNA, 1701 nt, Artificial Sequence; identical to SEQ ID NO: 33173
  hemagglutinin__InfluenzaA__ACR08419

SEQ ID NO: 33223 - RNA, 1701 nt, Artificial Sequence
  hemagglutinin__InfluenzaA__ACR08429
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33224 - RNA, 1701 nt, Artificial Sequence; identical to SEQ ID NO: 33173
  hemagglutinin__InfluenzaA__ACR08439

SEQ ID NO: 33225 - RNA, 1701 nt, Artificial Sequence; identical to SEQ ID NO: 33173
  hemagglutinin__InfluenzaA__ACR08449

SEQ ID NO: 33226 - RNA, 1701 nt, Artificial Sequence
  hemagglutinin__InfluenzaA__ACR08459
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcgauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33227 - RNA, 1701 nt, Artificial Sequence
  hemagglutinin__InfluenzaA__ACR08528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaaggcccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33228 - RNA, 1701 nt, Artificial Sequence; identical to SEQ ID NO: 33168
  hemagglutinin__InfluenzaA__ACR08530

SEQ ID NO: 33229 - RNA, 1701 nt, Artificial Sequence
  hemagglutinin__InfluenzaA__ACR08531
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcgauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33230 - RNA, 1701 nt, Artificial Sequence; identical to SEQ ID NO: 33173
  hemagglutinin__InfluenzaA__ACR08533

SEQ ID NO: 33231 - RNA, 1701 nt, Artificial Sequence; identical to SEQ ID NO: 33229
  hemagglutinin__InfluenzaA__ACR08535

SEQ ID NO: 33232 - RNA, 1701 nt, Artificial Sequence; identical to SEQ ID NO: 33173
  hemagglutinin__InfluenzaA__ACR08536

SEQ ID NO: 33233 - RNA, 1701 nt, Artificial Sequence; identical to SEQ ID NO: 33229
  hemagglutinin__InfluenzaA__ACR08537

SEQ ID NO: 33234 - RNA, 1701 nt, Artificial Sequence; identical to SEQ ID NO: 33229
  hemagglutinin__InfluenzaA__ACR08538

SEQ ID NO: 33235 - RNA, 1701 nt, Artificial Sequence; identical to SEQ ID NO: 33173
  hemagglutinin__InfluenzaA__ACR08539

SEQ ID NO: 33236 - RNA, 1701 nt, Artificial Sequence
  hemagglutinin__InfluenzaA__ACR08540
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33237 - RNA, 1701 nt, Artificial Sequence; identical to SEQ ID NO: 33160
  hemagglutinin__InfluenzaA__ACR08542

SEQ ID NO: 33238 - RNA, 1701 nt, Artificial Sequence; identical to SEQ ID NO: 33168
  hemagglutinin__InfluenzaA__ACR08543

SEQ ID NO: 33239 - RNA, 1701 nt, Artificial Sequence
  hemagglutinin__InfluenzaA__ACR08544
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33240 - RNA, 1701 nt, Artificial Sequence; identical to SEQ ID NO: 33229
  hemagglutinin__InfluenzaA__ACR08545

SEQ ID NO: 33241 - RNA, 1701 nt, Artificial Sequence
  hemagglutinin__InfluenzaA__ACR08546
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaggugagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33242 - RNA, 1701 nt, Artificial Sequence; identical to SEQ ID NO: 33173
  hemagglutinin__InfluenzaA__ACR08547

SEQ ID NO: 33243 - RNA, 1701 nt, Artificial Sequence; identical to SEQ ID NO: 33229
  hemagglutinin__InfluenzaA__ACR08548

SEQ ID NO: 33244 - RNA, 1701 nt, Artificial Sequence; identical to SEQ ID NO: 33173
  hemagglutinin__InfluenzaA__ACR08549

SEQ ID NO: 33245 - RNA, 1701 nt, Artificial Sequence; identical to SEQ ID NO: 33173
  hemagglutinin__InfluenzaA__ACR08550

SEQ ID NO: 33246 - RNA, 1701 nt, Artificial Sequence; identical to SEQ ID NO: 33173
  hemagglutinin__InfluenzaA__ACR08551

SEQ ID NO: 33247 - RNA, 1701 nt, Artificial Sequence; identical to SEQ ID NO: 33197
  hemagglutinin__InfluenzaA__ACR08552

SEQ ID NO: 33248 - RNA, 1701 nt, Artificial Sequence
  hemagglutinin__InfluenzaA__ACR08553
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33249 - RNA, 1701 nt, Artificial Sequence; identical to SEQ ID NO: 33239
  hemagglutinin__InfluenzaA__ACR08554

SEQ ID NO: 33250 - RNA, 1701 nt, Artificial Sequence
  hemagglutinin__InfluenzaA__ACR09365
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauauagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33251 - RNA, 1701 nt, Artificial Sequence; identical to SEQ ID NO: 33168
  hemagglutinin__InfluenzaA__ACR09366

SEQ ID NO: 33252 - RNA, 1701 nt, Artificial Sequence; identical to SEQ ID NO: 33168
  hemagglutinin__InfluenzaA__ACR09367

SEQ ID NO: 33253 - RNA, 1701 nt, Artificial Sequence
  hemagglutinin__InfluenzaA__ACR09368
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33254 - RNA, 1701 nt, Artificial Sequence; identical to SEQ ID NO: 33209
  hemagglutinin__InfluenzaA__ACR09369

SEQ ID NO: 33255 - RNA, 1701 nt, Artificial Sequence; identical to SEQ ID NO: 33197
  hemagglutinin__InfluenzaA__ACR09370

SEQ ID NO: 33256 - RNA, 1701 nt, Artificial Sequence; identical to SEQ ID NO: 33197
  hemagglutinin__InfluenzaA__ACR09371

SEQ ID NO: 33257 - RNA, 1701 nt, Artificial Sequence
  hemagglutinin__InfluenzaA__ACR09373
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33258 - RNA, 1701 nt, Artificial Sequence; identical to SEQ ID NO: 33197
  hemagglutinin__InfluenzaA__ACR09374

SEQ ID NO: 33259 - RNA, 1701 nt, Artificial Sequence
  hemagglutinin__InfluenzaA__ACR09375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33260 - RNA, 1701 nt, Artificial Sequence; identical to SEQ ID NO: 33209
  hemagglutinin__InfluenzaA__ACR09376

SEQ ID NO: 33261 - RNA, 1701 nt, Artificial Sequence; identical to SEQ ID NO: 33168
  hemagglutinin__InfluenzaA__ACR09377

SEQ ID NO: 33262 - RNA, 1701 nt, Artificial Sequence; identical to SEQ ID NO: 33168
  hemagglutinin__InfluenzaA__ACR09395

SEQ ID NO: 33263 - RNA, 1701 nt, Artificial Sequence; identical to SEQ ID NO: 33168
  hemagglutinin__InfluenzaA__ACR09396

SEQ ID NO: 33264 - RNA, 1701 nt, Artificial Sequence
  hemagglutinin__InfluenzaA__ACR10186
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33265 - RNA, 1701 nt, Artificial Sequence; identical to SEQ ID NO: 33264
  hemagglutinin__InfluenzaA__ACR10222

SEQ ID NO: 33266 - RNA, 1701 nt, Artificial Sequence
  hemagglutinin__InfluenzaA__ACR10223
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33267 - RNA, 1701 nt, Artificial Sequence
  hemagglutinin__InfluenzaA__ACR15183
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacgggagucacucaaaauggaacaagcucugcuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccaucggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 33268 - RNA, 1698 nt, Artificial Sequence
  hemagglutinin__InfluenzaA__ACR15194
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucauaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggccuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugaugguuuuauagacauuuggacauauaaugcagaacuguugguuuuacuggaaaaugaaaggacuuuggauuuccaugacuccaaugugaagaaucuguaugagaaaguaaaaagccaguuaaagaauaaugcuaaagaaauaggaaauagguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33269 - RNA, 1698 nt, Artificial Sequence
  hemagglutinin__InfluenzaA__ACR15216
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaaaaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuucaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 33270 - RNA, 1701 nt, Artificial Sequence
  hemagglutinin__InfluenzaA__ACR15227
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugccaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaaacaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagagacaaacuagaggcauauuuggcgcaaucgcggguuucauagaaaaugguugggagggaaugauggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33271 - RNA, 1698 nt, Artificial Sequence
  hemagglutinin__InfluenzaA__ACR15238
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguguccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucagcaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33272 - RNA, 1701 nt, Artificial Sequence
  hemagglutinin__InfluenzaA__ACR15249
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 33273 - RNA, 1701 nt, Artificial Sequence
  hemagglutinin__InfluenzaA__ACR15282
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucaugaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33274 - RNA, 1701 nt, Artificial Sequence
  hemagglutinin__InfluenzaA__ACR15293
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauuaggagacccucagugugauggcuuccaaaauaagaaaugggaccuuuuuguugaacgcagcaaagccuacagcaacuguuacccuuaugaugugccggauuaugccucccuuaggucacuaauugccucaucuggcacacuggaguuuaacaaugaaaacuucaauuggacgggagucacucaaaauggaacaagcucugcuugcaaaaggggaucugauaacaguuucuuuaguagauugaauugguugacccacuuaaaauucaaauacccagcauugaaagugacuaugccaaacaaugaaaaauuugacaaauuguacauuugggggguucaucacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggaggggaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaauuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 33275 - RNA, 1698 nt, Artificial Sequence
  hemagglutinin__InfluenzaA__ACR15304
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaaugggaagcuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagagagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacacagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaccagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacagauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 33276 - RNA, 1698 nt, Artificial Sequence
  hemagglutinin__InfluenzaA__ACR15315
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaaaaaugguuuguacccaaaccugagcauguccuauguaaacaacaaagagaaagaaguccuugugcuaugggguguucaucacccaccuaacauaagggaccagagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugggugguaugguuaucaucaucagaaugagcaaggaucuggcuaugcugcagaucaaaagagcacacaaaaugccauuaacgggauuacaaacaaggugaauucuguaauugaaaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuucaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 33277 - RNA, 1698 nt, Artificial Sequence
  hemagglutinin__InfluenzaA__ACR15326
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaaaaaugguuuguacccaaaccugagcauguccuauguaaacaacaaagaaaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugagaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaaggaggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 33278 - RNA, 1698 nt, Artificial Sequence
  hemagglutinin__InfluenzaA__ACR15359
augaaaguaaaacuacugguccuguuaugcacauuuacagcuacauaugcagacacaauauguauaggcuaccaugcuaacaacucaaccgacacuguugacacaguacuugaaaagaaugugacagugacacauucugucaaccugcuugagaacagucacaauggaaaacuaugucuauuaaaaggaauagccccacuacaauuggguaauugcagcguugccggauggaucuuaggaaacccagaaugcggauuacugauuuccaaggagucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucauuaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33279 - RNA, 1698 nt, Artificial Sequence
  hemagglutinin__InfluenzaA__ACR15370
augaaaguaaaacuacugguccuguuaugcacacuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaaccugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugauucuuuuggucucccugggggcaaucagcuucuggauguguuccaaugggucuuugcaauguagaauaugcaucuaa

SEQ ID NO: 33280 - RNA, 1701 nt, Artificial Sequence; identical to SEQ ID NO: 32806
  hemagglutinin__InfluenzaA__ACR15381

SEQ ID NO: 33281 - RNA, 1701 nt, Artificial Sequence; identical to SEQ ID NO: 32812
  hemagglutinin__InfluenzaA__ACR15392

SEQ ID NO: 33282 - RNA, 1701 nt, Artificial Sequence
  hemagglutinin__InfluenzaA__ACR15403
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuaccaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33283 - RNA, 1701 nt, Artificial Sequence; identical to SEQ ID NO: 32445
  hemagglutinin__InfluenzaA__ACR15414

SEQ ID NO: 33284 - RNA, 1698 nt, Artificial Sequence
  hemagglutinin__InfluenzaA__ACR15425
augaaaguaaaacuacugguccuguuaugcacauuuacagcuacauaugcagacacaauauguauaggcuaccaugcuaacaacucaaccgacacuguugacacaguacuugaaaagaaugugacagugacacauucugucaaccugcuugagaacagucacaauggaaaacuaugucuauuaaaaggaauagccccacuacaauuggguaauugcagcguugccggauggaucuuaggaaacccagaaugcggauuacugauuuccaaggagucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33285 - RNA, 1698 nt, Artificial Sequence
  hemagglutinin__InfluenzaA__ACR15436
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33286 - RNA, 1698 nt, Artificial Sequence
  hemagglutinin__InfluenzaA__ACR15458
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaacccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaccauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaagaaacaucccaucuauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuucuggucucccugggggcaaucagcuucuggauguguuccaaugggucuuugcaguguagaauaugcaucuaa

SEQ ID NO: 33287 - RNA, 1698 nt, Artificial Sequence
  hemagglutinin__InfluenzaA__ACR15469
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccagauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaaugggacuuaugacuauccaaaauauuccgaagaaucaaaguuaaacagggagaaaauugauggagugaaauuggaaucaaugggagucuaucagauucuggcgaucuauucaacagucgccaguucucugguucuuuuggucucccugggggcaaucagcuucuggauguguuccaaugggucuuugcaguguagaauaugcaucuaa

SEQ ID NO: 33288 - RNA, 1698 nt, Artificial Sequence
  hemagglutinin__InfluenzaA__ACR15480
augaaaguaaaacuacugguccuguuaugcacauuuacagcuacauacgcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaacaggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacuuaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33289 - RNA, 1698 nt, Artificial Sequence
  hemagglutinin__InfluenzaA__ACR15491
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaggaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggaauaaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33290 - RNA, 1698 nt, Artificial Sequence
  hemagglutinin__InfluenzaA__ACR15502
augaaaguaaaacuacugguccuguuaugcacauuuacagcuacauaugcggacacaauauguauaggcuaccaugcuaacaacgcgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33291 - RNA, 1698 nt, Artificial Sequence
  hemagglutinin__InfluenzaA__ACR15513
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaggcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaagagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacugggaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 33292 - RNA, 1701 nt, Artificial Sequence
  hemagglutinin__InfluenzaA__ACR15524
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaucgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaacggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 33293 - RNA, 1701 nt, Artificial Sequence; identical to SEQ ID NO: 33101
  hemagglutinin__InfluenzaA__ACR15535

SEQ ID NO: 33294 - RNA, 1701 nt, Artificial Sequence
  hemagglutinin__InfluenzaA__ACR15546
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucauauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggcuugccaaaaaggcaacauuaggugcaacauuugcauuuga

SEQ ID NO: 33295 - RNA, 1701 nt, Artificial Sequence; identical to SEQ ID NO: 32876
  hemagglutinin__InfluenzaA__ACR15557

SEQ ID NO: 33296 - RNA, 1701 nt, Artificial Sequence; identical to SEQ ID NO: 33142
  hemagglutinin__InfluenzaA__ACR15568

SEQ ID NO: 33297 - RNA, 1701 nt, Artificial Sequence
  hemagglutinin__InfluenzaA__ACR15579
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguucuucaacagguggaauaugcgacaguccucaucagauccuugauggagaaaauugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaacccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaucgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33298 - RNA, 1701 nt, Artificial Sequence
  hemagglutinin__InfluenzaA__ACR15590
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccguuuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33299 - RNA, 1701 nt, Artificial Sequence; identical to SEQ ID NO: 31139
  hemagglutinin__InfluenzaA__ACR15601

SEQ ID NO: 33300 - RNA, 1701 nt, Artificial Sequence
  hemagglutinin__InfluenzaA__ACR18920
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauauagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauauacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33301 - RNA, 1701 nt, Artificial Sequence; identical to SEQ ID NO: 33173
  hemagglutinin__InfluenzaA__ACR18975

SEQ ID NO: 33302 - RNA, 1701 nt, Artificial Sequence; identical to SEQ ID NO: 33197
  hemagglutinin__InfluenzaA__ACR18976

SEQ ID NO: 33303 - RNA, 1701 nt, Artificial Sequence; identical to SEQ ID NO: 33168
  hemagglutinin__InfluenzaA__ACR18977

SEQ ID NO: 33304 - RNA, 1701 nt, Artificial Sequence; identical to SEQ ID NO: 33175
  hemagglutinin__InfluenzaA__ACR18978

SEQ ID NO: 33305 - RNA, 1701 nt, Artificial Sequence; identical to SEQ ID NO: 33168
  hemagglutinin__InfluenzaA__ACR18979

SEQ ID NO: 33306 - RNA, 1701 nt, Artificial Sequence; identical to SEQ ID NO: 33229
  hemagglutinin__InfluenzaA__ACR18981

SEQ ID NO: 33307 - RNA, 1701 nt, Artificial Sequence
  hemagglutinin__InfluenzaA__ACR18982
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagaccuaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33308 - RNA, 1701 nt, Artificial Sequence; identical to SEQ ID NO: 33173
  hemagglutinin__InfluenzaA__ACR18988

SEQ ID NO: 33309 - RNA, 1701 nt, Artificial Sequence
  hemagglutinin__InfluenzaA__ACR18991
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacaggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33310 - RNA, 1701 nt, Artificial Sequence; identical to SEQ ID NO: 33160
  hemagglutinin__InfluenzaA__ACR18993

SEQ ID NO: 33311 - RNA, 1701 nt, Artificial Sequence; identical to SEQ ID NO: 33199
  hemagglutinin__InfluenzaA__ACR18995

SEQ ID NO: 33312 - RNA, 1701 nt, Artificial Sequence
  hemagglutinin__InfluenzaA__ACR23302
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucguuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauggagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33313 - RNA, 1701 nt, Artificial Sequence; identical to SEQ ID NO: 33173
  hemagglutinin__InfluenzaA__ACR33743

SEQ ID NO: 33314 - RNA, 1701 nt, Artificial Sequence; identical to SEQ ID NO: 33168
  hemagglutinin__InfluenzaA__ACR38821

SEQ ID NO: 33315 - RNA, 1701 nt, Artificial Sequence
  hemagglutinin__InfluenzaA__ACR38822
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33316 - RNA, 1701 nt, Artificial Sequence; identical to SEQ ID NO: 33160
  hemagglutinin__InfluenzaA__ACR38823

SEQ ID NO: 33317 - RNA, 1701 nt, Artificial Sequence; identical to SEQ ID NO: 33229
  hemagglutinin__InfluenzaA__ACR38824

SEQ ID NO: 33318 - RNA, 1701 nt, Artificial Sequence
  hemagglutinin__InfluenzaA__ACR38825
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33319 - RNA, 1701 nt, Artificial Sequence; identical to SEQ ID NO: 33173
  hemagglutinin__InfluenzaA__ACR38826

SEQ ID NO: 33320 - RNA, 1701 nt, Artificial Sequence; identical to SEQ ID NO: 33168
  hemagglutinin__InfluenzaA__ACR38827

SEQ ID NO: 33321 - RNA, 1701 nt, Artificial Sequence; identical to SEQ ID NO: 33229
  hemagglutinin__InfluenzaA__ACR38828

SEQ ID NO: 33322 - RNA, 1701 nt, Artificial Sequence
  hemagglutinin__InfluenzaA__ACR38829
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugucgaauauguauuuaa

SEQ ID NO: 33323 - RNA, 1701 nt, Artificial Sequence; identical to SEQ ID NO: 33199
  hemagglutinin__InfluenzaA__ACR38830

SEQ ID NO: 33324 - RNA, 1701 nt, Artificial Sequence; identical to SEQ ID NO: 33173
  hemagglutinin__InfluenzaA__ACR39354

SEQ ID NO: 33325 - RNA, 1701 nt, Artificial Sequence; identical to SEQ ID NO: 33173
  hemagglutinin__InfluenzaA__ACR39393

SEQ ID NO: 33326 - RNA, 1701 nt, Artificial Sequence; identical to SEQ ID NO: 33173
  hemagglutinin__InfluenzaA__ACR39403

SEQ ID NO: 33327 - RNA, 1701 nt, Artificial Sequence; identical to SEQ ID NO: 33173
  hemagglutinin__InfluenzaA__ACR39413

SEQ ID NO: 33328 - RNA, 1701 nt, Artificial Sequence; identical to SEQ ID NO: 33173
  hemagglutinin__InfluenzaA__ACR39423

SEQ ID NO: 33329 - RNA, 1701 nt, Artificial Sequence; identical to SEQ ID NO: 33173
  hemagglutinin__InfluenzaA__ACR39433

SEQ ID NO: 33330 - RNA, 1701 nt, Artificial Sequence; identical to SEQ ID NO: 33173
  hemagglutinin__InfluenzaA__ACR39443

SEQ ID NO: 33331 - RNA, 1701 nt, Artificial Sequence
  hemagglutinin__InfluenzaA__ACR39453
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33332 - RNA, 1701 nt, Artificial Sequence; identical to SEQ ID NO: 33173
  hemagglutinin__InfluenzaA__ACR39463

SEQ ID NO: 33333 - RNA, 1701 nt, Artificial Sequence; identical to SEQ ID NO: 33173
  hemagglutinin__InfluenzaA__ACR39473

SEQ ID NO: 33334 - RNA, 1701 nt, Artificial Sequence; identical to SEQ ID NO: 33173
  hemagglutinin__InfluenzaA__ACR39483

SEQ ID NO: 33335 - RNA, 1701 nt, Artificial Sequence; identical to SEQ ID NO: 33173
  hemagglutinin__InfluenzaA__ACR39493

SEQ ID NO: 33336 - RNA, 1701 nt, Artificial Sequence; identical to SEQ ID NO: 33173
  hemagglutinin__InfluenzaA__ACR40288

SEQ ID NO: 33337 - RNA, 1701 nt, Artificial Sequence; identical to SEQ ID NO: 33173
  hemagglutinin__InfluenzaA__ACR40298

SEQ ID NO: 33338 - RNA, 1701 nt, Artificial Sequence
  hemagglutinin__InfluenzaA__ACR40308
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauauauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33339 - RNA, 1701 nt, Artificial Sequence; identical to SEQ ID NO: 33173
  hemagglutinin__InfluenzaA__ACR40318

SEQ ID NO: 33340 - RNA, 1701 nt, Artificial Sequence; identical to SEQ ID NO: 33173
  hemagglutinin__InfluenzaA__ACR40328

SEQ ID NO: 33341 - RNA, 1701 nt, Artificial Sequence; identical to SEQ ID NO: 33173
  hemagglutinin__InfluenzaA__ACR40338

SEQ ID NO: 33342 - RNA, 1701 nt, Artificial Sequence; identical to SEQ ID NO: 33173
  hemagglutinin__InfluenzaA__ACR40348

SEQ ID NO: 33343 - RNA, 1701 nt, Artificial Sequence; identical to SEQ ID NO: 33173
  hemagglutinin__InfluenzaA__ACR40358

SEQ ID NO: 33344 - RNA, 1701 nt, Artificial Sequence; identical to SEQ ID NO: 33173
  hemagglutinin__InfluenzaA__ACR40378

SEQ ID NO: 33345 - RNA, 1701 nt, Artificial Sequence; identical to SEQ ID NO: 33173
  hemagglutinin__InfluenzaA__ACR40388

SEQ ID NO: 33346 - RNA, 1701 nt, Artificial Sequence; identical to SEQ ID NO: 33168
  hemagglutinin__InfluenzaA__ACR46986

SEQ ID NO: 33347 - RNA, 1701 nt, Artificial Sequence; identical to SEQ ID NO: 33168
  hemagglutinin__InfluenzaA__ACR46988

SEQ ID NO: 33348 - RNA, 1701 nt, Artificial Sequence; identical to SEQ ID NO: 33168
  hemagglutinin__InfluenzaA__ACR46989

SEQ ID NO: 33349 - RNA, 1701 nt, Artificial Sequence; identical to SEQ ID NO: 33168
  hemagglutinin__InfluenzaA__ACR46990

SEQ ID NO: 33350 - RNA, 1701 nt, Artificial Sequence
  hemagglutinin__InfluenzaA__ACR46992
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33351 - RNA, 1701 nt, Artificial Sequence; identical to SEQ ID NO: 33168
  hemagglutinin__InfluenzaA__ACR46993

SEQ ID NO: 33352 - RNA, 1701 nt, Artificial Sequence; identical to SEQ ID NO: 33168
  hemagglutinin__InfluenzaA__ACR46994

SEQ ID NO: 33353 - RNA, 1701 nt, Artificial Sequence
  hemagglutinin__InfluenzaA__ACR47006
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33354 - RNA, 1701 nt, Artificial Sequence; identical to SEQ ID NO: 33173
  hemagglutinin__InfluenzaA__ACR49281

SEQ ID NO: 33355 - RNA, 1701 nt, Artificial Sequence
  hemagglutinin__InfluenzaA__ACR49282
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33356 - RNA, 1701 nt, Artificial Sequence; identical to SEQ ID NO: 33160
  hemagglutinin__InfluenzaA__ACR49283

SEQ ID NO: 33357 - RNA, 1701 nt, Artificial Sequence; identical to SEQ ID NO: 33168
  hemagglutinin__InfluenzaA__ACR49288

SEQ ID NO: 33358 - RNA, 1701 nt, Artificial Sequence; identical to SEQ ID NO: 33199
  hemagglutinin__InfluenzaA__ACR49290

SEQ ID NO: 33359 - RNA, 1701 nt, Artificial Sequence; identical to SEQ ID NO: 33173
  hemagglutinin__InfluenzaA__ACR49291

SEQ ID NO: 33360 - RNA, 1701 nt, Artificial Sequence; identical to SEQ ID NO: 33199
  hemagglutinin__InfluenzaA__ACR49293

SEQ ID NO: 33361 - RNA, 1701 nt, Artificial Sequence; identical to SEQ ID NO: 33199
  hemagglutinin__InfluenzaA__ACR49295

SEQ ID NO: 33362 - RNA, 1701 nt, Artificial Sequence; identical to SEQ ID NO: 33213
  hemagglutinin__InfluenzaA__ACR50993

SEQ ID NO: 33363 - RNA, 1701 nt, Artificial Sequence; identical to SEQ ID NO: 33173
  hemagglutinin__InfluenzaA__ACR50995

SEQ ID NO: 33364 - RNA, 1701 nt, Artificial Sequence; identical to SEQ ID NO: 33173
  hemagglutinin__InfluenzaA__ACR51005

SEQ ID NO: 33365 - RNA, 1701 nt, Artificial Sequence; identical to SEQ ID NO: 33173
  hemagglutinin__InfluenzaA__ACR51015

SEQ ID NO: 33366 - RNA, 1701 nt, Artificial Sequence; identical to SEQ ID NO: 33173
  hemagglutinin__InfluenzaA__ACR51025

SEQ ID NO: 33367 - RNA, 1701 nt, Artificial Sequence; identical to SEQ ID NO: 33173
  hemagglutinin__InfluenzaA__ACR51035

SEQ ID NO: 33368 - RNA, 1701 nt, Artificial Sequence; identical to SEQ ID NO: 33173
  hemagglutinin__InfluenzaA__ACR51045

SEQ ID NO: 33369 - RNA, 1701 nt, Artificial Sequence; identical to SEQ ID NO: 33173
  hemagglutinin__InfluenzaA__ACR51055

SEQ ID NO: 33370 - RNA, 1701 nt, Artificial Sequence; identical to SEQ ID NO: 33168
  hemagglutinin__InfluenzaA__ACR51065

SEQ ID NO: 33371 - RNA, 1701 nt, Artificial Sequence; identical to SEQ ID NO: 33173
  hemagglutinin__InfluenzaA__ACR52368

SEQ ID NO: 33372 - RNA, 1701 nt, Artificial Sequence; identical to SEQ ID NO: 33173
  hemagglutinin__InfluenzaA__ACR52378

SEQ ID NO: 33373 - RNA, 1701 nt, Artificial Sequence; identical to SEQ ID NO: 33173
  hemagglutinin__InfluenzaA__ACR52398

SEQ ID NO: 33374 - RNA, 1701 nt, Artificial Sequence; identical to SEQ ID NO: 33173
  hemagglutinin__InfluenzaA__ACR52408

SEQ ID NO: 33375 - RNA, 1701 nt, Artificial Sequence; identical to SEQ ID NO: 33173
  hemagglutinin__InfluenzaA__ACR52418

SEQ ID NO: 33376 - RNA, 1701 nt, Artificial Sequence; identical to SEQ ID NO: 33173
  hemagglutinin__InfluenzaA__ACR52428

SEQ ID NO: 33377 - RNA, 1701 nt, Artificial Sequence; identical to SEQ ID NO: 33173
  hemagglutinin__InfluenzaA__ACR52438

SEQ ID NO: 33378 - RNA, 1701 nt, Artificial Sequence
  hemagglutinin__InfluenzaA__ACR52448
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33379 - RNA, 1701 nt, Artificial Sequence; identical to SEQ ID NO: 33173
  hemagglutinin__InfluenzaA__ACR52458

SEQ ID NO: 33380 - RNA, 1701 nt, Artificial Sequence; identical to SEQ ID NO: 33173
  hemagglutinin__InfluenzaA__ACR52468

SEQ ID NO: 33381 - RNA, 1701 nt, Artificial Sequence; identical to SEQ ID NO: 33173
  hemagglutinin__InfluenzaA__ACR52478

SEQ ID NO: 33382 - RNA, 1701 nt, Artificial Sequence; identical to SEQ ID NO: 33173
  hemagglutinin__InfluenzaA__ACR52488

SEQ ID NO: 33383 - RNA, 1701 nt, Artificial Sequence; identical to SEQ ID NO: 33206
  hemagglutinin__InfluenzaA__ACR54045

SEQ ID NO: 33384 - RNA, 1701 nt, Artificial Sequence
  hemagglutinin__InfluenzaA__ACR54047
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33385 - RNA, 1701 nt, Artificial Sequence
  hemagglutinin__InfluenzaA__ACR54964
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucauagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33386 - RNA, 1701 nt, Artificial Sequence; identical to SEQ ID NO: 33264
  hemagglutinin__InfluenzaA__ACR54974

SEQ ID NO: 33387 - RNA, 1701 nt, Artificial Sequence
  hemagglutinin__InfluenzaA__ACR54984
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33388 - RNA, 1701 nt, Artificial Sequence; identical to SEQ ID NO: 33168
  hemagglutinin__InfluenzaA__ACR54994

SEQ ID NO: 33389 - RNA, 1701 nt, Artificial Sequence
  hemagglutinin__InfluenzaA__ACR55004
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccagcucauugguacugguagucucccugggggcaaucaguuucuggaugugcucuaaugggucucuacaguguagaauauguauuuaa

SEQ ID NO: 33390 - RNA, 1701 nt, Artificial Sequence
  hemagglutinin__InfluenzaA__ACR56380
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33391 - RNA, 1701 nt, Artificial Sequence; identical to SEQ ID NO: 33229
  hemagglutinin__InfluenzaA__ACR56390

SEQ ID NO: 33392 - RNA, 1701 nt, Artificial Sequence; identical to SEQ ID NO: 33173
  hemagglutinin__InfluenzaA__ACR56400

SEQ ID NO: 33393 - RNA, 1701 nt, Artificial Sequence; identical to SEQ ID NO: 33173
  hemagglutinin__InfluenzaA__ACR56410

SEQ ID NO: 33394 - RNA, 1701 nt, Artificial Sequence; identical to SEQ ID NO: 33173
  hemagglutinin__InfluenzaA__ACR56420

SEQ ID NO: 33395 - RNA, 1701 nt, Artificial Sequence; identical to SEQ ID NO: 33173
  hemagglutinin__InfluenzaA__ACR56430

SEQ ID NO: 33396 - RNA, 1701 nt, Artificial Sequence; identical to SEQ ID NO: 33173
  hemagglutinin__InfluenzaA__ACR56440

SEQ ID NO: 33397 - RNA, 1698 nt, Artificial Sequence
  hemagglutinin__InfluenzaA__ACR58541
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugaucuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacgaggaagaaugguuuguacccaaaccugagcaaguccuaugcaaacaacaaagaaaaagaaguccuuguacuaugggguguucaucacccgccaaacauaggugaccaaaaggcacucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugauaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33398 - RNA, 1698 nt, Artificial Sequence; identical to SEQ ID NO: 32454
  hemagglutinin__InfluenzaA__ACR61655

SEQ ID NO: 33399 - RNA, 1698 nt, Artificial Sequence
  hemagglutinin__InfluenzaA__ACR61666
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcguaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuauaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaauguagaauaugcaucuaa

SEQ ID NO: 33400 - RNA, 1701 nt, Artificial Sequence
  hemagglutinin__InfluenzaA__ACR61677
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaucuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33401 - RNA, 1701 nt, Artificial Sequence
  hemagglutinin__InfluenzaA__ACR61688
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguaacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33402 - RNA, 1701 nt, Artificial Sequence; identical to SEQ ID NO: 33053
  hemagglutinin__InfluenzaA__ACR61699

SEQ ID NO: 33403 - RNA, 1701 nt, Artificial Sequence
  hemagglutinin__InfluenzaA__ACR67170
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccugaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacuguugccaguucauugguacugguagucucccugggggcaaucaguuucuggaugugcucuaaugggucucuacaguguagaauauguauuuaa

SEQ ID NO: 33404 - RNA, 1701 nt, Artificial Sequence; identical to SEQ ID NO: 33199
  hemagglutinin__InfluenzaA__ACR67171

SEQ ID NO: 33405 - RNA, 1701 nt, Artificial Sequence; identical to SEQ ID NO: 33168
  hemagglutinin__InfluenzaA__ACR67172

SEQ ID NO: 33406 - RNA, 1701 nt, Artificial Sequence
  hemagglutinin__InfluenzaA__ACR67177
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 33407 - RNA, 1701 nt, Artificial Sequence; identical to SEQ ID NO: 33315
  hemagglutinin__InfluenzaA__ACR67181

SEQ ID NO: 33408 - RNA, 1701 nt, Artificial Sequence
  hemagglutinin__InfluenzaA__ACR67183
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaauauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 33409 - RNA, 1701 nt, Artificial Sequence; identical to SEQ ID NO: 33173
  hemagglutinin__InfluenzaA__ACR67184

SEQ ID NO: 33410 - RNA, 1701 nt, Artificial Sequence; identical to SEQ ID NO: 33168
  hemagglutinin__InfluenzaA__ACR67185

SEQ ID NO: 33411 - RNA, 1701 nt, Artificial Sequence; identical to SEQ ID NO: 33390
  hemagglutinin__InfluenzaA__ACR67186

SEQ ID NO: 33412 - RNA, 1701 nt, Artificial Sequence; identical to SEQ ID NO: 33197
  hemagglutinin__InfluenzaA__ACR67187

SEQ ID NO: 33413 - RNA, 1701 nt, Artificial Sequence
  hemagglutinin__InfluenzaA__ACR67188
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaaggaagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33414 - RNA, 1701 nt, Artificial Sequence
  hemagglutinin__InfluenzaA__ACR67189
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuuuaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33415 - RNA, 1701 nt, Artificial Sequence
  hemagglutinin__InfluenzaA__ACR67190
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacgcccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33416 - RNA, 1701 nt, Artificial Sequence; identical to SEQ ID NO: 33168
  hemagglutinin__InfluenzaA__ACR67192

SEQ ID NO: 33417 - RNA, 1701 nt, Artificial Sequence
  hemagglutinin__InfluenzaA__ACR67193
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgagugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33418 - RNA, 1701 nt, Artificial Sequence; identical to SEQ ID NO: 33197
  hemagglutinin__InfluenzaA__ACR67195

SEQ ID NO: 33419 - RNA, 1701 nt, Artificial Sequence
  hemagglutinin__InfluenzaA__ACR67197
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33420 - RNA, 1701 nt, Artificial Sequence; identical to SEQ ID NO: 33417
  hemagglutinin__InfluenzaA__ACR67198

SEQ ID NO: 33421 - RNA, 1701 nt, Artificial Sequence
  hemagglutinin__InfluenzaA__ACR67199
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaggaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33422 - RNA, 1701 nt, Artificial Sequence; identical to SEQ ID NO: 33206
  hemagglutinin__InfluenzaA__ACR67244

SEQ ID NO: 33423 - RNA, 1701 nt, Artificial Sequence
  hemagglutinin__InfluenzaA__ACR67254
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauguuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33424 - RNA, 1701 nt, Artificial Sequence
  hemagglutinin__InfluenzaA__ACR77438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33425 - RNA, 1701 nt, Artificial Sequence; identical to SEQ ID NO: 33173
  hemagglutinin__InfluenzaA__ACR77448

SEQ ID NO: 33426 - RNA, 1701 nt, Artificial Sequence
  hemagglutinin__InfluenzaA__ACR77458
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggauaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33427 - RNA, 1701 nt, Artificial Sequence; identical to SEQ ID NO: 33173
  hemagglutinin__InfluenzaA__ACR77468

SEQ ID NO: 33428 - RNA, 1701 nt, Artificial Sequence; identical to SEQ ID NO: 33173
  hemagglutinin__InfluenzaA__ACR77478

SEQ ID NO: 33429 - RNA, 1701 nt, Artificial Sequence; identical to SEQ ID NO: 33173
  hemagglutinin__InfluenzaA__ACR77488

SEQ ID NO: 33430 - RNA, 1701 nt, Artificial Sequence
  hemagglutinin__InfluenzaA__ACR77498
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuugaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33431 - RNA, 1701 nt, Artificial Sequence
  hemagglutinin__InfluenzaA__ACR83525
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33432 - RNA, 1701 nt, Artificial Sequence
  hemagglutinin__InfluenzaA__ACR83538
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucuaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33433 - RNA, 1701 nt, Artificial Sequence; identical to SEQ ID NO: 33173
  hemagglutinin__InfluenzaA__ACS14666

SEQ ID NO: 33434 - RNA, 1701 nt, Artificial Sequence; identical to SEQ ID NO: 33173
  hemagglutinin__InfluenzaA__ACS14676

SEQ ID NO: 33435 - RNA, 1701 nt, Artificial Sequence; identical to SEQ ID NO: 33173
  hemagglutinin__InfluenzaA__ACS14686

SEQ ID NO: 33436 - RNA, 1701 nt, Artificial Sequence; identical to SEQ ID NO: 33173
  hemagglutinin__InfluenzaA__ACS14696

SEQ ID NO: 33437 - RNA, 1701 nt, Artificial Sequence; identical to SEQ ID NO: 33173
  hemagglutinin__InfluenzaA__ACS14706

SEQ ID NO: 33438 - RNA, 1701 nt, Artificial Sequence; identical to SEQ ID NO: 33173
  hemagglutinin__InfluenzaA__ACS14716

SEQ ID NO: 33439 - RNA, 1701 nt, Artificial Sequence; identical to SEQ ID NO: 33173
  hemagglutinin__InfluenzaA__ACS14726

SEQ ID NO: 33440 - RNA, 1701 nt, Artificial Sequence; identical to SEQ ID NO: 33173
  hemagglutinin__InfluenzaA__ACS14736

SEQ ID NO: 33441 - RNA, 1701 nt, Artificial Sequence; identical to SEQ ID NO: 33390
  hemagglutinin__InfluenzaA__ACS27189

SEQ ID NO: 33442 - RNA, 1701 nt, Artificial Sequence; identical to SEQ ID NO: 33173
  hemagglutinin__InfluenzaA__ACS27199

SEQ ID NO: 33443 - RNA, 1701 nt, Artificial Sequence; identical to SEQ ID NO: 33173
  hemagglutinin__InfluenzaA__ACS27209

SEQ ID NO: 33444 - RNA, 1701 nt, Artificial Sequence; identical to SEQ ID NO: 33229
  hemagglutinin__InfluenzaA__ACS27219

SEQ ID NO: 33445 - RNA, 1701 nt, Artificial Sequence; identical to SEQ ID NO: 33173
  hemagglutinin__InfluenzaA__ACS27229

SEQ ID NO: 33446 - RNA, 1701 nt, Artificial Sequence
  hemagglutinin__InfluenzaA__ACS27239
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuuuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33447 - RNA, 1701 nt, Artificial Sequence; identical to SEQ ID NO: 33173
  hemagglutinin__InfluenzaA__ACS27249

SEQ ID NO: 33448 - RNA, 1701 nt, Artificial Sequence; identical to SEQ ID NO: 33173
  hemagglutinin__InfluenzaA__ACS27775

SEQ ID NO: 33449 - RNA, 1701 nt, Artificial Sequence
  hemagglutinin__InfluenzaA__ACS34705
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33450 - RNA, 1701 nt, Artificial Sequence; identical to SEQ ID NO: 33168
  hemagglutinin__InfluenzaA__ACS34966

SEQ ID NO: 33451 - RNA, 1701 nt, Artificial Sequence
  hemagglutinin__InfluenzaA__ACS34967
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuaccccggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaaucgagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaagccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33452 - RNA, 1701 nt, Artificial Sequence
  hemagglutinin__InfluenzaA__ACS34968
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaucaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuaagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaauauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33453 - RNA, 1701 nt, Artificial Sequence
  hemagglutinin__InfluenzaA__ACS36632
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaagccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33454 - RNA, 1701 nt, Artificial Sequence
  hemagglutinin__InfluenzaA__ACS36645
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggaacaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaagcaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33455 - RNA, 1701 nt, Artificial Sequence
  hemagglutinin__InfluenzaA__ACS45035
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagauacauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33456 - RNA, 1701 nt, Artificial Sequence; identical to SEQ ID NO: 33173
  hemagglutinin__InfluenzaA__ACS50084

SEQ ID NO: 33457 - RNA, 1701 nt, Artificial Sequence
  hemagglutinin__InfluenzaA__ACS50095
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33458 - RNA, 1701 nt, Artificial Sequence
  hemagglutinin__InfluenzaA__ACS54258
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuauuacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33459 - RNA, 1701 nt, Artificial Sequence
  hemagglutinin__InfluenzaA__ACS54259
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggucaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33460 - RNA, 1701 nt, Artificial Sequence; identical to SEQ ID NO: 33168
  hemagglutinin__InfluenzaA__ACS54260

SEQ ID NO: 33461 - RNA, 1701 nt, Artificial Sequence; identical to SEQ ID NO: 33173
  hemagglutinin__InfluenzaA__ACS54261

SEQ ID NO: 33462 - RNA, 1701 nt, Artificial Sequence; identical to SEQ ID NO: 33173
  hemagglutinin__InfluenzaA__ACS54263

SEQ ID NO: 33463 - RNA, 1701 nt, Artificial Sequence; identical to SEQ ID NO: 33387
  hemagglutinin__InfluenzaA__ACS54301

SEQ ID NO: 33464 - RNA, 1701 nt, Artificial Sequence
  hemagglutinin__InfluenzaA__ACS66821
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33465 - RNA, 1701 nt, Artificial Sequence
  hemagglutinin__InfluenzaA__ACS68822
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacggcaagcucaugguccuacauuguggaaacaucuaguucagacaauggaacguguuacccaggagauuucaucgauuaugaggggcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33466 - RNA, 1701 nt, Artificial Sequence; identical to SEQ ID NO: 33173
  hemagglutinin__InfluenzaA__ACS75821

SEQ ID NO: 33467 - RNA, 1701 nt, Artificial Sequence; identical to SEQ ID NO: 33173
  hemagglutinin__InfluenzaA__ACS77926

SEQ ID NO: 33468 - RNA, 1701 nt, Artificial Sequence; identical to SEQ ID NO: 33173
  hemagglutinin__InfluenzaA__ACS77936

SEQ ID NO: 33469 - RNA, 1701 nt, Artificial Sequence; identical to SEQ ID NO: 33266
  hemagglutinin__InfluenzaA__ACS77946

SEQ ID NO: 33470 - RNA, 1701 nt, Artificial Sequence; identical to SEQ ID NO: 33173
  hemagglutinin__InfluenzaA__ACS77956

SEQ ID NO: 33471 - RNA, 1701 nt, Artificial Sequence; identical to SEQ ID NO: 33173
  hemagglutinin__InfluenzaA__ACS77966

SEQ ID NO: 33472 - RNA, 1701 nt, Artificial Sequence
  hemagglutinin__InfluenzaA__ACS77976
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33473 - RNA, 1701 nt, Artificial Sequence
  hemagglutinin__InfluenzaA__ACS77986
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33474 - RNA, 1701 nt, Artificial Sequence
  hemagglutinin__InfluenzaA__ACS77996
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33475 - RNA, 1701 nt, Artificial Sequence; identical to SEQ ID NO: 33173
  hemagglutinin__InfluenzaA__ACS78006

SEQ ID NO: 33476 - RNA, 1701 nt, Artificial Sequence; identical to SEQ ID NO: 33173
  hemagglutinin__InfluenzaA__ACS78016

SEQ ID NO: 33477 - RNA, 1701 nt, Artificial Sequence
  hemagglutinin__InfluenzaA__ACS78026
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacucgaacagagguguaacggcagcauguccucaugcuggagcaaaaagcuucuacaaaaauuuaauauggcuaguuaaaaaaggaaauucauacccaaagcucaucaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33478 - RNA, 1701 nt, Artificial Sequence; identical to SEQ ID NO: 33457
  hemagglutinin__InfluenzaA__ACS78036

SEQ ID NO: 33479 - RNA, 1701 nt, Artificial Sequence; identical to SEQ ID NO: 33457
  hemagglutinin__InfluenzaA__ACS78046

SEQ ID NO: 33480 - RNA, 1701 nt, Artificial Sequence; identical to SEQ ID NO: 33459
  hemagglutinin__InfluenzaA__ACS92569

SEQ ID NO: 33481 - RNA, 1701 nt, Artificial Sequence; identical to SEQ ID NO: 33459
  hemagglutinin__InfluenzaA__ACS92579

SEQ ID NO: 33482 - RNA, 1701 nt, Artificial Sequence; identical to SEQ ID NO: 33173
  hemagglutinin__InfluenzaA__ACS92589

SEQ ID NO: 33483 - RNA, 1701 nt, Artificial Sequence
  hemagglutinin__InfluenzaA__ACS92612
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccauucaugacucgaacaaagguguaacggcagcauguccccaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccugaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcgauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuggugcugguagucucccugggggcaaucaguuucuggaugugcucuaaugggucucuacaguguagaauauguauuuga

SEQ ID NO: 33484 - RNA, 1701 nt, Artificial Sequence; identical to SEQ ID NO: 33173
  hemagglutinin__InfluenzaA__ACT10307

SEQ ID NO: 33485 - RNA, 1701 nt, Artificial Sequence; identical to SEQ ID NO: 33173
  hemagglutinin__InfluenzaA__ACT10314

SEQ ID NO: 33486 - RNA, 1701 nt, Artificial Sequence
  hemagglutinin__InfluenzaA__ACT11057
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33487 - RNA, 1704 nt, Artificial Sequence
  hemagglutinin__InfluenzaA__ACT15312
auggagaaaauagugcuucuucuugcaauagucaguauuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagagggcuauuuggagcuauagcaggguuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33488 - RNA, 1704 nt, Artificial Sequence
  hemagglutinin__InfluenzaA__ACT15314
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaagaacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauaacuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagcgaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33489 - RNA, 1704 nt, Artificial Sequence
  hemagglutinin__InfluenzaA__ACT15316
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuauccagggaauuucaacgacuaugaagaacugaaacaucuauugagcagaauaaaccauuuugagaaaauucagaucauccccaaaaauucuuggucagaucaugaagccucaggagugagcucagcauguccauaccagggaagguccuccuuuuuuagaaaugugguauggcuuaccaaaaaggacaaugcauacccaacaauaaagagaaguuacaauaauaccaaccaagaagaucuuuugguacuauggggaauucaccauccaaaugaugcggcagagcagacaaggcuuuaucaaaacccaacuaccuauauuuccguugggacaucaacacuaaaccagagauugauaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcuaagaaauagcccucaaggagagagaagaagaaaaaagagaggacuauuuggagcuauagcagguuucauagagggaggauggcagggaaugguagaugguugguauggguaccaccauagcaacgagcaggggagugguuacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgguuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacuuucaauuuauucaacaguggcgagcucccuagcacuggcaaucaugguggcuggucuauuuuuauggaugugcuccaauggaucguuacaaugcagaauuugcauuuaa

SEQ ID NO: 33490 - RNA, 1704 nt, Artificial Sequence
  hemagglutinin__InfluenzaA__ACT15320
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggaaugagcucagcauguccauaccagggaagauccuccuuuuuuagaaaugugguauggcuuaccaaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacggacaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33491 - RNA, 1704 nt, Artificial Sequence
  hemagglutinin__InfluenzaA__ACT15322
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaaggacaaugcauacccaacaauaaaaagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacggacaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaguagaauagaaaauuuaaacaagaagauggaagacggauuccuagaugucuggacuuauaaugcugaacuucugguucucauggaaaaugaaagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33492 - RNA, 1704 nt, Artificial Sequence
  hemagglutinin__InfluenzaA__ACT15326
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacggaaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauccagaucauccccaaaaauucuuggucagaucaugaagccucaggagugagcucagcauguccauaccagggaagauccuccuuuuuuagaaaugugguauggcuuaccaaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugauaccaaaaauagcuacuagaucuaagguaaacgggcaaaguggaaggauggaguucuuuuggacaauuuuaaaaccgaaugaugcaauaaauuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcuaagaaauagcccucaaggagagagaagaagaaaaaagagaggacuauuuggagcuauagcagguuucauagagggaggauggcagggaaugguagaugguugguauggguaccaccauagcaacgagcaggggagugguuacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgguuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33493 - RNA, 1704 nt, Artificial Sequence
  hemagglutinin__InfluenzaA__ACT15328
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagguccuccuuuuuuagaaaugugguauggcuuaccaaaaaggacaaugcauacccaacaauaaagagaaguuacaauaauacaaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacggacaaaauggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaauugcaacaccaagugucagacuccaauaggggcgauaaacuccaguaugccauuccacaacauccacccccucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcauuauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33494 - RNA, 1704 nt, Artificial Sequence
  hemagglutinin__InfluenzaA__ACT15330
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaauuuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagguccuccuuuuuuagaaaugugguauggcuuaccaaaaaggacaaugcauacccaacaauaaagagaaguuacaauaauacaaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacggacaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaauugcaacaccaagugucagacuccaauaggggcgauaaacuccaguaugccauuccacaacauccacccccucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcauuauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33495 - RNA, 1707 nt, Artificial Sequence
  hemagglutinin__InfluenzaA__ACT15332
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaagcuaugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagaucaugaagcaucgucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucauaacccaacuaccuauauuuccguugggacaucaacacuaaaccagagauugguaccaaaaauagcuacuagaucuaagauaaaugggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaagcagauuaguccuugcuacugggcucagaaauaguccucaaggaaagaguagaagaaaaaagagaggacuauuuggagcuauagcaggguuuauagagggaggauggcagggaaugguagaugguugguauggguaccaccauagcaacgagcaggggaguggguacgcugcagacaaagaauccacucaaagggcaauagauggagucaccaauaaggucaacucgaucauugacaaaaugaacacccaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaauguuaagaaucuuuacgacaagguccgacuacagcuuagggauaaugcaaaggagcuuggcaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33496 - RNA, 1704 nt, Artificial Sequence
  hemagglutinin__InfluenzaA__ACT15336
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacggacaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33497 - RNA, 1704 nt, Artificial Sequence
  hemagglutinin__InfluenzaA__ACT15338
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuacaaaaaagaacaaugcauacccaacaauaaagagaaguuacaauaauaccaaccaagaagaucuuuugguacuaugggggauucaccauccaaaugaugcgacagagcagacaaggcuuuaucaaaacccaacuaccuauauuuccguugggacaucaacacuaaaccagagauugauaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccccucaccaucggggaaugccccaaauaugugaaaucaaacagauuaguccuugcuaccgggcuaagaaauagcccucaagaagggagaagaagaaaaaagagaggacuauuuggagcuauagcagguuucauagagggaggauggcagggaaugguagaugguugguauggguaccaccauagcaacgagcaggggagugguuacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgguuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33498 - RNA, 1704 nt, Artificial Sequence
  hemagglutinin__InfluenzaA__ACT15340
auggagaaaauagugcuucuucuugcaauagucagucuuguuaaaagugaucaaauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaagaacaaugcauacccaacaauaaagagaaguuacaauaauaccaaccaagaagaucuuuugguacuaugggggauucaccauccaaaugaugcggaagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaaugccuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuuggcaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33499 - RNA, 1704 nt, Artificial Sequence
  hemagglutinin__InfluenzaA__ACT15342
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaguuucaacgacuaugaagaacugaaacaccuauugagcagaauaaaccauuuugagaaaauucagaucauccccaagaauucuuggucagaucaugaagccucaggagugagcucagcauguccauaccagggaagauccuccuuuuuuagaaaugugguauggcuuaccaaaaaggacaaugcauacccaacaauaaagagaaguuacaauaacaccaaccaagaagaucuuuugguacuaugggggauucaccauccaaaugaugcggcagagcaaacaaggcuuuaucaaaacccaacuaccuauauuuccguuggaacaucaacacuaaaccagagauugguaccaaaaauugcuacuagaucuaagguaaacgggcaaaguggaaggauggaguucuuuuggacaauuuuaaaaccgaaugaugcaauaaacuuugaaaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaauccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaaaauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33500 - RNA, 1704 nt, Artificial Sequence; identical to SEQ ID NO: 33496
  hemagglutinin__InfluenzaA__ACT15343

SEQ ID NO: 33501 - RNA, 1704 nt, Artificial Sequence
  hemagglutinin__InfluenzaA__ACT15345
auggagaaaauagugcuucuucuugcaauagucagucuuguuaagagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucaucauguccauaccagggaagauccuccuuuuuuagaaaugugguauggcuuaccaaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccaaagauugguaccaaaaauagcuacuagaucuaagguaaacggacaaaguggaaggauggaguucuuuuggacaauuuuaaaaucgaaugaugcaauaaacuuugggaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33502 - RNA, 1707 nt, Artificial Sequence
  hemagglutinin__InfluenzaA__ACT15347
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaagcuaugugaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagaucaugaagcaucgucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucauaacccaacuaccuauauuuccguugggacaucaacacuaaaccagagauugguaccaaaaauagcuacuagaucuaagguaaaugggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaagcagauuaguccuugcuacugggcucagaaauaguccucaaggaaagaauagaagaaaaaagagaggacuguuuggagcuauagcagguuuuauagagggaggauggcagggaaugguagaugguugguauggguaccaccauagcaacgagcaggggaguggguacgcugcagacaaagaauccacucaaagggcaauagauggggucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaauguuaagaaucuuuacgacaagguccgacuacagcuuagggauaaugcaaaggagcuuggcaacgguuguuucgaguucuaucacagaugugauaaugaauguauggaaaguguaaggaacggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33503 - RNA, 1704 nt, Artificial Sequence
  hemagglutinin__InfluenzaA__ACT15349
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacuaugcaaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuacaaaaaaggacaaugcauacccaacaauaaagagaaguuacaauaauaccaaccaagaagaucuuuugguacuaugggggauucaccauccaaaugaugcgacagagcagacaaggcuuuaucaaaacccaacuaccuauauuuccguugggacaucaacacuaaaccagagauugauaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccccucaccaucggggaaugccccaaauaugugaaaucaaacagauuaguccuugcuacugggcuaagaaauagcccucaagaagagagaagaagaaaaaagagaggacuauuuggagcuauagcagguuucauagagggaggauggcagggaaugguagaugguugguauggguaccaccauagcaacgagcaggggagugguuacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgguuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33504 - RNA, 1707 nt, Artificial Sequence
  hemagglutinin__InfluenzaA__ACT15351
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaagcuaugcgaucuagauggagugaagccucuaauuuuaagagauuguaguguagcuggauggcuccucgggaauccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagaucaugaagcaucgucaggagugagcucagcauguccauaccagggaggauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcggagcagacaaggcucuaucauaacccaacuaccuauauuuccguugggacaucaacacuaaaccagagauugguaccaaaaauagcuacuagaucuaagguaaaugggcaaaguggaaggauggaguucuuuuggacaauuuuaaaaccgaaugaugcaauaaacuuugagaguaauggaaauuucauugcuccagaaaaugcauauaaaauugucaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaagcagauuaguccuugcuacugggcucagaaauaguccucaaggaaagaguagaagaaaaaagagaggacuauuuggagcuauagcaggguuuauagagggaggauggcagggaaugguagaugguugguauggguaccaccauagcaacgagcaggggaguggguacgcugcagacaaagaauccacucaaagggcaauagauggagucaccaauaaggucaacucgaucauugacaaaaugaacacucaguuugaggcuguuggaagggaauuuaauaaauuagaaaggagaauagaaaauuuaaacaagaagauggaagacggauuucuagaugucuggacuuauaaugcugaacuucugguucucauggaaaaugagagaacucuagacuuucaugacucaaauguuaagaaucuuuacgacaagguccgacuacagcuuagggauaaugcaaaggagcuuggcaacgguuguuucgaguucuaucacagaugugacaaugaauguauggaaaguguaagaaacggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33505 - RNA, 1704 nt, Artificial Sequence
  hemagglutinin__InfluenzaA__ACT15353
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaagaacagugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuaggucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauauaguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggggucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33506 - RNA, 1707 nt, Artificial Sequence
  hemagglutinin__InfluenzaA__ACT15355
auggagaaaauagugcuucuucuugcaauagucagucuuguuaaaagugaucaaauuugcauugguuaccaugcaaacaacucgacagaacagguugacacaauaauggaaaagaacgucacuguuacacacgcccaagacauacuggaaaagacacacaacgggaagcuaugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccaggggauuucaacgacuaugaagaacugaaacaccuauugagcagaauaaaccauuuugagaaaauucagaucauccccaaaaguucuuggucagaucaugaagcaucgucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucauaacccaacuaccuauauuuccguugggacaucaacacuaaaccagagauugguaccaaaaauagcuacuagaucuaagguaaaugggcaaaguggaaggauggaguucuuuuggacaauuuuaaaaccgaaugaugcaauaaacuuugagaguaauggaaauuucauugcuccagaaaaugcauacaaaauuguuaagaaaggggacucaacaauuaugaaaagugaguuggaauaugguaacugcaacaccaagugucaaacuccaauaggggcgauaaacuccaguaugccauuccacaacauccacccucucaccaucggggaaugccccaaauaugugaaaucaagcagacuaguccuugcuacugggcucagaaauaguccucaaggaaagaguagaagaaaaaagagaggacuauuuggagcuauagcaggguuuauagagggaggauggcagggaaugguagaugguugguauggguaccaccauagcaacgagcaggggaguggguacgcugcagacaaagaauccacucaaagggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaauguuaagaaucuuuacgacaagguccgacuacagcuuagggauaaugcaaaggagcuuggcaacgguuguuucgaguucuaucacagaugugauaaugaauguauggaaaguguaagaaauggaacguaugacuacccgcaguauucagaagaagcaagauuaaaaagagaggaaauaaguggaguaaaauuggaaucaauaggaauuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33507 - RNA, 1704 nt, Artificial Sequence
  hemagglutinin__InfluenzaA__ACT15357
auggagaaaauagugcuucuucuugcaauagucagucuuguuaaaagugaucagauuugcauugguuaccaugcaaacaacucgacagagcagguugacacaauaauggaaagaaacgucacuguuacacacgcccaggacauacuggaaaagacacacaacgggaaacucugcaaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuacccaaaaggacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugauaccaaaaauagcuacuagauccaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugucccaaauaugugaaaucaaacagauuaguccuugcuacugggcuaagaaauagcccucaaggagagagaagaagaaaaaagagaggacuauuuggagcuauagcagguuucauagagggaggauggcagggaaugguagaugguugguauggguaccaccauagcaacgagcaggggagugguuacgcugcagacaaagaauccacucaaaaggcaauagauggagucaccaauaaggucaacucgaucauugacaaaaugaacacucaguuugaggcuguuggaagggaauuuaauaacuuagaaaggaggauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgguuacagcuuagggauaacgcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 33508 - RNA, 1701 nt, Artificial Sequence
  hemagglutinin__InfluenzaA__ACT20200
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33509 - RNA, 1701 nt, Artificial Sequence
  hemagglutinin__InfluenzaA__ACT21466
augaagacuaucauugcuuugagcuacauuuuaugucugguuuucgcucaaaaacuucccggaaaugacaacagcacggcaacgccgugccugggacaccaugcagugccaaacggaacgcuagugaaaacaaucacgaaugaccaaauugaagugacuaaugcuacugagcugguucagaguuccucaacagguaaaauaugcgacaguccucaccgaauccuugauggaaaaaacugcacacugauagaugcucuauugggagacccucauugugacggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaagaaagcaacugagggaaaaugcugaggacaugggcaaugguugcuucaaaauauaucacaaaugugacaaugccuguauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33510 - RNA, 1701 nt, Artificial Sequence
  hemagglutinin__InfluenzaA__ACT21467
augaagacuaucauugcuuugagcuacauuuuaugucugguuuucgcucaaaaacuucccggaagugacaacagcacggcaacgcugugccugggacaccaugcagugccaaacggaacgcuagugaaaacaaucacgaaugaccaaauugaagugacuaaugcuacugagcugguucagaguuccucaacagguaaaauaugcgacaguccucaccgaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguaucuccagcagaauaagcgucuauuggacaauaguaaaaccgagagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccgaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaagaaagcaacugagggaaaaugcugaggacaugggcaaugguugcuucaaaauauaucacaaaugugacaaugccuguauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33511 - RNA, 1701 nt, Artificial Sequence
  hemagglutinin__InfluenzaA__ACT21468
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguaaaauaugcgacaguccucaccgaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaagaaagcaacugagggaaaauguugaggacaugggcaaugguugcuucaaaauauaucacaaaugugacaaugccuguauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33512 - RNA, 1701 nt, Artificial Sequence
  hemagglutinin__InfluenzaA__ACT21469
augaagacuaucauugcuuugagcuacauuucacgucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucaggauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcaggcuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 33513 - RNA, 1701 nt, Artificial Sequence
  hemagglutinin__InfluenzaA__ACT21471
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucaggauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcaggcuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 33514 - RNA, 1701 nt, Artificial Sequence
  hemagglutinin__InfluenzaA__ACT21472
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucaggauggaacaagcuaugcuugcaaaaggagaucuauuaaaaguuucuuuaguacauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcaggcuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 33515 - RNA, 1701 nt, Artificial Sequence
  hemagglutinin__InfluenzaA__ACT21507
augaagacuaucauugcuuugagcuacauucuaugucugguuuucgcucagaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaaccgcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaagggagaucuaauaacaguuucuuuaguagauugaauugguugacccauuuaaaauucaaauacccagcauugaacgugacuaugccaaacaaugaaaaguuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauagugaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuagaauagaucucuggucauacaacgcggagcuucuuguugcccuggagagccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaacgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33516 - RNA, 1701 nt, Artificial Sequence
  hemagglutinin__InfluenzaA__ACT21508
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaagacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33517 - RNA, 1701 nt, Artificial Sequence
  hemagglutinin__InfluenzaA__ACT21509
augaagacuauuauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguagccucauccggcacacuggaguuuaacaaugaaagcuucaauuggacuggagucacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuuuaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaaccgaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaaugaaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33518 - RNA, 1701 nt, Artificial Sequence
  hemagglutinin__InfluenzaA__ACT21510
augaagacuaucauugccuugagcuacauucuauguccgguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauagugaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaagauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacagagaagcaacugagggaaaaugcugaggauaugggcaaugguuguuucaaaauauaccacaaaugugacaaugccggcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33519 - RNA, 1701 nt, Artificial Sequence; identical to SEQ ID NO: 33417
  hemagglutinin__InfluenzaA__ACT21572

SEQ ID NO: 33520 - RNA, 1701 nt, Artificial Sequence; identical to SEQ ID NO: 33173
  hemagglutinin__InfluenzaA__ACT22031

SEQ ID NO: 33521 - RNA, 1701 nt, Artificial Sequence
  hemagglutinin__InfluenzaA__ACT22032
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33522 - RNA, 1701 nt, Artificial Sequence; identical to SEQ ID NO: 33173
  hemagglutinin__InfluenzaA__ACT22033

SEQ ID NO: 33523 - RNA, 1701 nt, Artificial Sequence
  hemagglutinin__InfluenzaA__ACT22034
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacguguauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33524 - RNA, 1701 nt, Artificial Sequence; identical to SEQ ID NO: 33459
  hemagglutinin__InfluenzaA__ACT22035

SEQ ID NO: 33525 - RNA, 1701 nt, Artificial Sequence
  hemagglutinin__InfluenzaA__ACT22036
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33526 - RNA, 1701 nt, Artificial Sequence
  hemagglutinin__InfluenzaA__ACT22037
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaagauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagaaaauuuaaauaaaaaaguugaugaugguuuccuggacauuuggacuuacaaugccgaacuguugguucuauuggaaaaugaaaggacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgcaaguucauugguacugguagucucccugggggcaaucaguuucuggaugugcucuaaugggucucuacaguguagaauauguauuuaa

SEQ ID NO: 33527 - RNA, 1701 nt, Artificial Sequence
  hemagglutinin__InfluenzaA__ACT22038
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33528 - RNA, 1701 nt, Artificial Sequence
  hemagglutinin__InfluenzaA__ACT22055
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagaaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33529 - RNA, 1701 nt, Artificial Sequence; identical to SEQ ID NO: 33486
  hemagglutinin__InfluenzaA__ACT22504

SEQ ID NO: 33530 - RNA, 1701 nt, Artificial Sequence; identical to SEQ ID NO: 33457
  hemagglutinin__InfluenzaA__ACT33122

SEQ ID NO: 33531 - RNA, 1701 nt, Artificial Sequence
  hemagglutinin__InfluenzaA__ACT33123
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuugaaucaacaaggauuuaccagauuuuggcgaucuauucaacugucgccaguucauugguacugguagucucccugggggcaaucaguuucuggaugugcucuaaugggucucuacaguuuagaauauguauuuaa

SEQ ID NO: 33532 - RNA, 1701 nt, Artificial Sequence; identical to SEQ ID NO: 33173
  hemagglutinin__InfluenzaA__ACT33125

SEQ ID NO: 33533 - RNA, 1701 nt, Artificial Sequence
  hemagglutinin__InfluenzaA__ACT36505
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33534 - RNA, 1701 nt, Artificial Sequence
  hemagglutinin__InfluenzaA__ACT36649
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagaucaugguccuacauuguggaaacaucuaguucagacaauggaacguguuacccaggagauuucaucgauuaugaggagcuaagagagcaauugaacucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagagcuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33535 - RNA, 1701 nt, Artificial Sequence; identical to SEQ ID NO: 33173
  hemagglutinin__InfluenzaA__ACT36650

SEQ ID NO: 33536 - RNA, 1701 nt, Artificial Sequence; identical to SEQ ID NO: 33173
  hemagglutinin__InfluenzaA__ACT36652

SEQ ID NO: 33537 - RNA, 1701 nt, Artificial Sequence; identical to SEQ ID NO: 33171
  hemagglutinin__InfluenzaA__ACT36653

SEQ ID NO: 33538 - RNA, 1701 nt, Artificial Sequence
  hemagglutinin__InfluenzaA__ACT36655
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33539 - RNA, 1701 nt, Artificial Sequence; identical to SEQ ID NO: 33168
  hemagglutinin__InfluenzaA__ACT36658

SEQ ID NO: 33540 - RNA, 1701 nt, Artificial Sequence; identical to SEQ ID NO: 33199
  hemagglutinin__InfluenzaA__ACT36659

SEQ ID NO: 33541 - RNA, 1701 nt, Artificial Sequence; identical to SEQ ID NO: 33168
  hemagglutinin__InfluenzaA__ACT36661

SEQ ID NO: 33542 - RNA, 1701 nt, Artificial Sequence; identical to SEQ ID NO: 33206
  hemagglutinin__InfluenzaA__ACT36663

SEQ ID NO: 33543 - RNA, 1701 nt, Artificial Sequence
  hemagglutinin__InfluenzaA__ACT36666
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacugcugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33544 - RNA, 1701 nt, Artificial Sequence
  hemagglutinin__InfluenzaA__ACT52687
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagguuuuaccagauuuuggcgaucuauucaacugucgccaguucauugguacugguagucucccugggggcaaucaguuucuggaugugcucuaaugggucucuacaguguagaauauguauuuaa

SEQ ID NO: 33545 - RNA, 1701 nt, Artificial Sequence
  hemagglutinin__InfluenzaA__ACT54606
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33546 - RNA, 1701 nt, Artificial Sequence; identical to SEQ ID NO: 33173
  hemagglutinin__InfluenzaA__ACT66146

SEQ ID NO: 33547 - RNA, 1701 nt, Artificial Sequence; identical to SEQ ID NO: 33457
  hemagglutinin__InfluenzaA__ACT66155

SEQ ID NO: 33548 - RNA, 1701 nt, Artificial Sequence
  hemagglutinin__InfluenzaA__ACT66162
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcauuugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgauuuauucaacugucgccaguucauugguacugguagucucccugggggcaaucaguuucuggaugugcucuaaugggucucuacaguguagaauauguauuuaa

SEQ ID NO: 33549 - RNA, 1701 nt, Artificial Sequence; identical to SEQ ID NO: 33173
  hemagglutinin__InfluenzaA__ACT67239

SEQ ID NO: 33550 - RNA, 1701 nt, Artificial Sequence; identical to SEQ ID NO: 33173
  hemagglutinin__InfluenzaA__ACT67255

SEQ ID NO: 33551 - RNA, 1701 nt, Artificial Sequence; identical to SEQ ID NO: 33168
  hemagglutinin__InfluenzaA__ACT68102

SEQ ID NO: 33552 - RNA, 1701 nt, Artificial Sequence
  hemagglutinin__InfluenzaA__ACT68103
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33553 - RNA, 1701 nt, Artificial Sequence; identical to SEQ ID NO: 33168
  hemagglutinin__InfluenzaA__ACT68104

SEQ ID NO: 33554 - RNA, 1701 nt, Artificial Sequence
  hemagglutinin__InfluenzaA__ACT68105
augaaagcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucaggggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33555 - RNA, 1701 nt, Artificial Sequence; identical to SEQ ID NO: 33197
  hemagglutinin__InfluenzaA__ACT68106

SEQ ID NO: 33556 - RNA, 1701 nt, Artificial Sequence; identical to SEQ ID NO: 33197
  hemagglutinin__InfluenzaA__ACT68107

SEQ ID NO: 33557 - RNA, 1701 nt, Artificial Sequence; identical to SEQ ID NO: 33390
  hemagglutinin__InfluenzaA__ACT68108

SEQ ID NO: 33558 - RNA, 1701 nt, Artificial Sequence
  hemagglutinin__InfluenzaA__ACT68109
augaaggcaauacuaguaguucugcuauauacauuugcaaccgcaaauacagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33559 - RNA, 1701 nt, Artificial Sequence; identical to SEQ ID NO: 33168
  hemagglutinin__InfluenzaA__ACT68110

SEQ ID NO: 33560 - RNA, 1701 nt, Artificial Sequence
  hemagglutinin__InfluenzaA__ACT68112
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacucuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33561 - RNA, 1701 nt, Artificial Sequence; identical to SEQ ID NO: 33197
  hemagglutinin__InfluenzaA__ACT68113

SEQ ID NO: 33562 - RNA, 1701 nt, Artificial Sequence; identical to SEQ ID NO: 33168
  hemagglutinin__InfluenzaA__ACT68115

SEQ ID NO: 33563 - RNA, 1701 nt, Artificial Sequence; identical to SEQ ID NO: 33168
  hemagglutinin__InfluenzaA__ACT68119

SEQ ID NO: 33564 - RNA, 1701 nt, Artificial Sequence
  hemagglutinin__InfluenzaA__ACT79133
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggaaacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33565 - RNA, 1701 nt, Artificial Sequence
  hemagglutinin__InfluenzaA__ACT79143
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33566 - RNA, 1701 nt, Artificial Sequence; identical to SEQ ID NO: 33239
  hemagglutinin__InfluenzaA__ACT79153

SEQ ID NO: 33567 - RNA, 1701 nt, Artificial Sequence; identical to SEQ ID NO: 33486
  hemagglutinin__InfluenzaA__ACT79163

SEQ ID NO: 33568 - RNA, 1701 nt, Artificial Sequence; identical to SEQ ID NO: 33486
  hemagglutinin__InfluenzaA__ACT79173

SEQ ID NO: 33569 - RNA, 1701 nt, Artificial Sequence
  hemagglutinin__InfluenzaA__ACT79625
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauugaaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33570 - RNA, 1701 nt, Artificial Sequence
  hemagglutinin__InfluenzaA__ACT79627
augaaggcaauacuaguaguucugcuauauacauuugcaaccgcaaaugccgacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33571 - RNA, 1701 nt, Artificial Sequence
  hemagglutinin__InfluenzaA__ACT82512
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuuaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33572 - RNA, 1701 nt, Artificial Sequence; identical to SEQ ID NO: 33173
  hemagglutinin__InfluenzaA__ACT82513

SEQ ID NO: 33573 - RNA, 1701 nt, Artificial Sequence
  hemagglutinin__InfluenzaA__ACT82514
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucaaauacaccaguccacgauugcaauacaacuugucagacacccaaggguucuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33574 - RNA, 1701 nt, Artificial Sequence; identical to SEQ ID NO: 33173
  hemagglutinin__InfluenzaA__ACT82515

SEQ ID NO: 33575 - RNA, 1701 nt, Artificial Sequence
  hemagglutinin__InfluenzaA__ACT82516
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33576 - RNA, 1701 nt, Artificial Sequence; identical to SEQ ID NO: 33457
  hemagglutinin__InfluenzaA__ACT83795

SEQ ID NO: 33577 - RNA, 1701 nt, Artificial Sequence; identical to SEQ ID NO: 33457
  hemagglutinin__InfluenzaA__ACT83805

SEQ ID NO: 33578 - RNA, 1701 nt, Artificial Sequence; identical to SEQ ID NO: 33173
  hemagglutinin__InfluenzaA__ACT83815

SEQ ID NO: 33579 - RNA, 1701 nt, Artificial Sequence; identical to SEQ ID NO: 33173
  hemagglutinin__InfluenzaA__ACT83825

SEQ ID NO: 33580 - RNA, 1701 nt, Artificial Sequence; identical to SEQ ID NO: 33173
  hemagglutinin__InfluenzaA__ACT83835

SEQ ID NO: 33581 - RNA, 1701 nt, Artificial Sequence; identical to SEQ ID NO: 33266
  hemagglutinin__InfluenzaA__ACT83845

SEQ ID NO: 33582 - RNA, 1701 nt, Artificial Sequence
  hemagglutinin__InfluenzaA__ACT83855
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaauauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33583 - RNA, 1701 nt, Artificial Sequence; identical to SEQ ID NO: 33173
  hemagglutinin__InfluenzaA__ACT83865

SEQ ID NO: 33584 - RNA, 1701 nt, Artificial Sequence; identical to SEQ ID NO: 33457
  hemagglutinin__InfluenzaA__ACT83875

SEQ ID NO: 33585 - RNA, 1701 nt, Artificial Sequence; identical to SEQ ID NO: 33457
  hemagglutinin__InfluenzaA__ACT85999

SEQ ID NO: 33586 - RNA, 1701 nt, Artificial Sequence; identical to SEQ ID NO: 33457
  hemagglutinin__InfluenzaA__ACT86009

SEQ ID NO: 33587 - RNA, 1701 nt, Artificial Sequence; identical to SEQ ID NO: 33173
  hemagglutinin__InfluenzaA__ACT86019

SEQ ID NO: 33588 - RNA, 1701 nt, Artificial Sequence; identical to SEQ ID NO: 33266
  hemagglutinin__InfluenzaA__ACT86029

SEQ ID NO: 33589 - RNA, 1701 nt, Artificial Sequence; identical to SEQ ID NO: 33173
  hemagglutinin__InfluenzaA__ACT86039

SEQ ID NO: 33590 - RNA, 1701 nt, Artificial Sequence; identical to SEQ ID NO: 33173
  hemagglutinin__InfluenzaA__ACT86059

SEQ ID NO: 33591 - RNA, 1701 nt, Artificial Sequence; identical to SEQ ID NO: 33173
  hemagglutinin__InfluenzaA__ACT86069

SEQ ID NO: 33592 - RNA, 1701 nt, Artificial Sequence; identical to SEQ ID NO: 33173
  hemagglutinin__InfluenzaA__ACT86079

SEQ ID NO: 33593 - RNA, 1701 nt, Artificial Sequence; identical to SEQ ID NO: 33173
  hemagglutinin__InfluenzaA__ACT86089

SEQ ID NO: 33594 - RNA, 1701 nt, Artificial Sequence
  hemagglutinin__InfluenzaA__ACT86099
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33595 - RNA, 1701 nt, Artificial Sequence; identical to SEQ ID NO: 33457
  hemagglutinin__InfluenzaA__ACT86109

SEQ ID NO: 33596 - RNA, 1701 nt, Artificial Sequence; identical to SEQ ID NO: 33173
  hemagglutinin__InfluenzaA__ACT86119

SEQ ID NO: 33597 - RNA, 1701 nt, Artificial Sequence; identical to SEQ ID NO: 33457
  hemagglutinin__InfluenzaA__ACT86129

SEQ ID NO: 33598 - RNA, 1701 nt, Artificial Sequence; identical to SEQ ID NO: 33173
  hemagglutinin__InfluenzaA__ACT86139

SEQ ID NO: 33599 - RNA, 1701 nt, Artificial Sequence
  hemagglutinin__InfluenzaA__ACU00932
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaauuucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33600 - RNA, 1701 nt, Artificial Sequence
  hemagglutinin__InfluenzaA__ACU00942
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33601 - RNA, 1701 nt, Artificial Sequence; identical to SEQ ID NO: 33600
  hemagglutinin__InfluenzaA__ACU00952

SEQ ID NO: 33602 - RNA, 1701 nt, Artificial Sequence
  hemagglutinin__InfluenzaA__ACU12494
augaagacuaucauugcuuugagcuacauuuuaugucugguuuucgcccaaaaacuuccuggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagaguggggaaagcuaugcuugcaaaaggggaucuguuaaaaguuucuuuaguagauugaauugguugcacgaaucagauuacaaauauccagcgcugaacgugacuaugccaaacaauggcaaauuugacaaauuguacauuugggggguucaccacccgaucacggacagagaacaaaccagccuauauguucgagcaucagggagagucacagucuccaccaaaagaagccaacaaacugugaucccgaauaucggguccagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcgaaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33603 - RNA, 1698 nt, Artificial Sequence; identical to SEQ ID NO: 33285
  hemagglutinin__InfluenzaA__ACU12505

SEQ ID NO: 33604 - RNA, 1701 nt, Artificial Sequence
  hemagglutinin__InfluenzaA__ACU12516
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccucgauggagaaaacugcacacuaguagaugcucuauugggagacccucagugugauggcuuccaaaauaaaaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggaguaacucagaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcccaagcaucaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagacacaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33605 - RNA, 1701 nt, Artificial Sequence; identical to SEQ ID NO: 31139
  hemagglutinin__InfluenzaA__ACU12527

SEQ ID NO: 33606 - RNA, 1701 nt, Artificial Sequence
  hemagglutinin__InfluenzaA__ACU12538
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaaccguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33607 - RNA, 1701 nt, Artificial Sequence; identical to SEQ ID NO: 32072
  hemagglutinin__InfluenzaA__ACU12549

SEQ ID NO: 33608 - RNA, 1698 nt, Artificial Sequence
  hemagglutinin__InfluenzaA__ACU12560
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaauguaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33609 - RNA, 1698 nt, Artificial Sequence
  hemagglutinin__InfluenzaA__ACU12571
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagccacaauggaaaacuaugucuauuaaaaggaauagccccacuacaauuggguaauugcagcguugccggguggaucuuaggaaauccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuauuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaaggaggauggaaaacuugaacaaaaaaguugaugauggguuuauagacauuuggaccuacaaugcagaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucucugcaguguagaauaugcaucuaa

SEQ ID NO: 33610 - RNA, 1698 nt, Artificial Sequence
  hemagglutinin__InfluenzaA__ACU12582
augaaaguaaaacuacugguccuguuaugcacauuuacagcuacauaugcggacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggauggaucuuaggaaacccagaaugcgaauuacugauuuccaaggagucauggucuuacauuguagaaaaaccaaauccugagaauggaacauguuacccagggcguuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaaggaaaagaaguccuuguacuaugggguguucaucacccgccaaacauaggugaccaaaauacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaagguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33611 - RNA, 1698 nt, Artificial Sequence
  hemagglutinin__InfluenzaA__ACU12593
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagggaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauugaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggaauaaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33612 - RNA, 1701 nt, Artificial Sequence; identical to SEQ ID NO: 33173
  hemagglutinin__InfluenzaA__ACU13090

SEQ ID NO: 33613 - RNA, 1701 nt, Artificial Sequence; identical to SEQ ID NO: 33173
  hemagglutinin__InfluenzaA__ACU13091

SEQ ID NO: 33614 - RNA, 1701 nt, Artificial Sequence
  hemagglutinin__InfluenzaA__ACU13092
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33615 - RNA, 1701 nt, Artificial Sequence; identical to SEQ ID NO: 33173
  hemagglutinin__InfluenzaA__ACU13093

SEQ ID NO: 33616 - RNA, 1701 nt, Artificial Sequence
  hemagglutinin__InfluenzaA__ACU13094
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33617 - RNA, 1701 nt, Artificial Sequence; identical to SEQ ID NO: 33173
  hemagglutinin__InfluenzaA__ACU13095

SEQ ID NO: 33618 - RNA, 1701 nt, Artificial Sequence
  hemagglutinin__InfluenzaA__ACU13096
augaaggcaauacuaguaguucugcuacauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaacgcuggaaucaacaaggauuuaccagauuuuggcgaucuauucaacugucgccaguucauuggugcugguagucucccugggggcaaucaguuucuggaugugcucuaaugggucucuacaguguagaauauguauuuaa

SEQ ID NO: 33619 - RNA, 1701 nt, Artificial Sequence; identical to SEQ ID NO: 33173
  hemagglutinin__InfluenzaA__ACU13098

SEQ ID NO: 33620 - RNA, 1701 nt, Artificial Sequence
  hemagglutinin__InfluenzaA__ACU13099
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33621 - RNA, 1701 nt, Artificial Sequence
  hemagglutinin__InfluenzaA__ACU13129
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggugaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33622 - RNA, 1701 nt, Artificial Sequence
  hemagglutinin__InfluenzaA__ACU16795
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33623 - RNA, 1701 nt, Artificial Sequence
  hemagglutinin__InfluenzaA__ACU16858
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugggucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33624 - RNA, 1701 nt, Artificial Sequence; identical to SEQ ID NO: 33623
  hemagglutinin__InfluenzaA__ACU16930

SEQ ID NO: 33625 - RNA, 1701 nt, Artificial Sequence; identical to SEQ ID NO: 33206
  hemagglutinin__InfluenzaA__ACU16993

SEQ ID NO: 33626 - RNA, 1701 nt, Artificial Sequence; identical to SEQ ID NO: 33206
  hemagglutinin__InfluenzaA__ACU17059

SEQ ID NO: 33627 - RNA, 1701 nt, Artificial Sequence; identical to SEQ ID NO: 33173
  hemagglutinin__InfluenzaA__ACU17126

SEQ ID NO: 33628 - RNA, 1701 nt, Artificial Sequence; identical to SEQ ID NO: 33264
  hemagglutinin__InfluenzaA__ACU17187

SEQ ID NO: 33629 - RNA, 1701 nt, Artificial Sequence; identical to SEQ ID NO: 33173
  hemagglutinin__InfluenzaA__ACU17258

SEQ ID NO: 33630 - RNA, 1701 nt, Artificial Sequence
  hemagglutinin__InfluenzaA__ACU17389
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacagcuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33631 - RNA, 1701 nt, Artificial Sequence; identical to SEQ ID NO: 33173
  hemagglutinin__InfluenzaA__ACU17450

SEQ ID NO: 33632 - RNA, 1701 nt, Artificial Sequence; identical to SEQ ID NO: 33173
  hemagglutinin__InfluenzaA__ACU17521

SEQ ID NO: 33633 - RNA, 1701 nt, Artificial Sequence; identical to SEQ ID NO: 33197
  hemagglutinin__InfluenzaA__ACU27041

SEQ ID NO: 33634 - RNA, 1698 nt, Artificial Sequence
  hemagglutinin__InfluenzaA__ACU27406
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaauaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagagaaugaacacucaauucacagcagugggcaaagaauucaacaaauuggaaagaaggauggaaaacuugaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33635 - RNA, 1698 nt, Artificial Sequence
  hemagglutinin__InfluenzaA__ACU27407
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33636 - RNA, 1701 nt, Artificial Sequence; identical to SEQ ID NO: 33160
  hemagglutinin__InfluenzaA__ACU29949

SEQ ID NO: 33637 - RNA, 1701 nt, Artificial Sequence
  hemagglutinin__InfluenzaA__ACU29979
augaaggcaauacuaguaguucugcuauauacauuugcagccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33638 - RNA, 1701 nt, Artificial Sequence; identical to SEQ ID NO: 33173
  hemagglutinin__InfluenzaA__ACU29989

SEQ ID NO: 33639 - RNA, 1704 nt, Artificial Sequence
  hemagglutinin__InfluenzaA__ACU29999
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuugaaucaacaaggauuuaccagauuuuggcgaucuauucaacugucgccaguucauugguacugguagucucccugggggcaaucaguuucuggaugugcucuaaugggucucuucuacaguguagaauauguauuuaa

SEQ ID NO: 33640 - RNA, 1704 nt, Artificial Sequence
  hemagglutinin__InfluenzaA__ACU30009
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuggauaugggucucuacaguguagaauauguauuuaa

SEQ ID NO: 33641 - RNA, 1701 nt, Artificial Sequence; identical to SEQ ID NO: 33533
  hemagglutinin__InfluenzaA__ACU30019

SEQ ID NO: 33642 - RNA, 1701 nt, Artificial Sequence; identical to SEQ ID NO: 33353
  hemagglutinin__InfluenzaA__ACU30093

SEQ ID NO: 33643 - RNA, 1701 nt, Artificial Sequence
  hemagglutinin__InfluenzaA__ACU30103
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagggguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33644 - RNA, 1704 nt, Artificial Sequence
  hemagglutinin__InfluenzaA__ACU30112
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucucauaugguccugcuacaguguagaauauguauuuaa

SEQ ID NO: 33645 - RNA, 1701 nt, Artificial Sequence
  hemagglutinin__InfluenzaA__ACU30121
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33646 - RNA, 1701 nt, Artificial Sequence; identical to SEQ ID NO: 33266
  hemagglutinin__InfluenzaA__ACU31124

SEQ ID NO: 33647 - RNA, 1701 nt, Artificial Sequence; identical to SEQ ID NO: 33205
  hemagglutinin__InfluenzaA__ACU31143

SEQ ID NO: 33648 - RNA, 1701 nt, Artificial Sequence; identical to SEQ ID NO: 33205
  hemagglutinin__InfluenzaA__ACU31144

SEQ ID NO: 33649 - RNA, 1701 nt, Artificial Sequence; identical to SEQ ID NO: 33205
  hemagglutinin__InfluenzaA__ACU31145

SEQ ID NO: 33650 - RNA, 1701 nt, Artificial Sequence; identical to SEQ ID NO: 33390
  hemagglutinin__InfluenzaA__ACU31146

SEQ ID NO: 33651 - RNA, 1701 nt, Artificial Sequence; identical to SEQ ID NO: 33173
  hemagglutinin__InfluenzaA__ACU31147

SEQ ID NO: 33652 - RNA, 1701 nt, Artificial Sequence
  hemagglutinin__InfluenzaA__ACU31148
augaaggcaauacuaguaauuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33653 - RNA, 1701 nt, Artificial Sequence; identical to SEQ ID NO: 33197
  hemagglutinin__InfluenzaA__ACU31149

SEQ ID NO: 33654 - RNA, 1701 nt, Artificial Sequence; identical to SEQ ID NO: 33560
  hemagglutinin__InfluenzaA__ACU31150

SEQ ID NO: 33655 - RNA, 1701 nt, Artificial Sequence; identical to SEQ ID NO: 33560
  hemagglutinin__InfluenzaA__ACU31151

SEQ ID NO: 33656 - RNA, 1701 nt, Artificial Sequence; identical to SEQ ID NO: 33560
  hemagglutinin__InfluenzaA__ACU31152

SEQ ID NO: 33657 - RNA, 1707 nt, Artificial Sequence
  hemagglutinin__InfluenzaA__ACU46644
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagggaagccucuaauuuugagagauuguaggguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugguggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccaccauauacauccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaaccacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugaugaugaauguauggaaaguguaagaaacggaacguaugacuacccgcaguauucagaagaagcaagacuaaaaagagaggaaauaaguggaguaaaauuggaaucgauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 33658 - RNA, 1701 nt, Artificial Sequence
  hemagglutinin__InfluenzaA__ACU56924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33659 - RNA, 1701 nt, Artificial Sequence
  hemagglutinin__InfluenzaA__ACU56931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33660 - RNA, 1701 nt, Artificial Sequence; identical to SEQ ID NO: 33173
  hemagglutinin__InfluenzaA__ACU64792

SEQ ID NO: 33661 - RNA, 1701 nt, Artificial Sequence; identical to SEQ ID NO: 33390
  hemagglutinin__InfluenzaA__ACU64801

SEQ ID NO: 33662 - RNA, 1701 nt, Artificial Sequence; identical to SEQ ID NO: 33390
  hemagglutinin__InfluenzaA__ACU64812

SEQ ID NO: 33663 - RNA, 1701 nt, Artificial Sequence; identical to SEQ ID NO: 32823
  hemagglutinin__InfluenzaA__ACU79871

SEQ ID NO: 33664 - RNA, 1701 nt, Artificial Sequence
  hemagglutinin__InfluenzaA__ACU79882
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucugguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaaggaagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggaauuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 33665 - RNA, 1701 nt, Artificial Sequence; identical to SEQ ID NO: 32908
  hemagglutinin__InfluenzaA__ACU79893

SEQ ID NO: 33666 - RNA, 1701 nt, Artificial Sequence; identical to SEQ ID NO: 32909
  hemagglutinin__InfluenzaA__ACU79904

SEQ ID NO: 33667 - RNA, 1698 nt, Artificial Sequence
  hemagglutinin__InfluenzaA__ACU79937
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucaucauuugagagauucgaaauauuccccaaagaaagcucauggcccaaccacaccguaacaggaguaacggcaucaugcucccauaaugggaaaagcaguuuuuacagaaauuugcuauggcugacggagaaaaauggcuuguacccaaaucugagcaauuccuaugugaacaacaaagagaaagaaguccuuguacuaugggguguucaucacccaucuaacauagggguccaaagggccaucuaucauacagaaaacgcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugggucaggaaucaucaccucaaaugcaccaaugaaugaaugugaugcgaagugucaaacaccucagggagcuauaaacaguagucuuccuuuccagaauguacacccagucacaauaggagaguguccaaaguaugucaggaguacaaaauuaaggaugguuacaggacuaaggaauaucccauccauucaauccagagguuuguuuggagccauugccgguuucauugaagggggguggacuggaaugauggaugggugguaugguuaucaucaucagaaugagcaaggaucuggcuaugcugcagaucaaaaaagcacacaaaaugccauuaacgggauuacaaauaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaagugaaaagccaauuaaagaauaaugccaaagaaauagggaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 33668 - RNA, 1689 nt, Artificial Sequence
  hemagglutinin__InfluenzaA__ACU79948
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucagauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaauguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 33669 - RNA, 1689 nt, Artificial Sequence
  hemagglutinin__InfluenzaA__ACU79959
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucagauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 33670 - RNA, 1701 nt, Artificial Sequence
  hemagglutinin__InfluenzaA__ACU79970
augaagacuaucauugcuuugagcuacauucaaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguaaauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33671 - RNA, 1698 nt, Artificial Sequence
  hemagglutinin__InfluenzaA__ACU79981
augaaaguaaaacuacugguccuguuaugcacauuuacagcuacauaugcagacacaauauguauaggcuaccaugcuaacaacucgaccgacacuguugacacaguacuugaaaggaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuuaaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33672 - RNA, 1698 nt, Artificial Sequence
  hemagglutinin__InfluenzaA__ACU79992
augaaaguaaaacuacugguccuauuaugcacauuuacagcuacauaugcggacacaauauguaucggcuaccaugccaacaacucaaccgacacuguugacacaguacuugaaaagaaugugacagugacacacucugucaaccugcuugaggacaaccacaauggaaaacuaugucuauuaaaaggaaaagccccauuacaauuggguaacugcagcguugccggguggaucuuaggaaacccagaaugcggauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaacucuguaauugagaagaugaacacucaauucacagcuguaggcaaagaauucaacaaauuggaaagaaggauggaaaacuuaaauaaaaaaguugaugacggguuuauagacguuuggacauauaaugcagaacuguugguucuacuagaaaaugaaaggacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33673 - RNA, 1701 nt, Artificial Sequence
  hemagglutinin__InfluenzaA__ACU80003
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33674 - RNA, 1698 nt, Artificial Sequence
  hemagglutinin__InfluenzaA__ACU80025
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33675 - RNA, 1701 nt, Artificial Sequence
  hemagglutinin__InfluenzaA__ACU80036
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaguucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauaggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33676 - RNA, 1698 nt, Artificial Sequence; identical to SEQ ID NO: 33147
  hemagglutinin__InfluenzaA__ACU80047

SEQ ID NO: 33677 - RNA, 1701 nt, Artificial Sequence
  hemagglutinin__InfluenzaA__ACU80058
augaagaccaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugccacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccugcagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33678 - RNA, 1698 nt, Artificial Sequence; identical to SEQ ID NO: 33090
  hemagglutinin__InfluenzaA__ACU80069

SEQ ID NO: 33679 - RNA, 1698 nt, Artificial Sequence
  hemagglutinin__InfluenzaA__ACU80080
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggaauaaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33680 - RNA, 1698 nt, Artificial Sequence
  hemagglutinin__InfluenzaA__ACU80091
augaaaguaaaacuacugguccuguuaugcacauuuacagcuacauaugcagacacaauauguauaggcuaccaugcuaacaacucaaccgacacuguugacacaguacuugaaaagaaugugacagugacacauucugucaaccugcuugagaacagucacaauggaaaacuaugucuauuaaaaggaauagccccacuacaauuggguaauugcagcguugccggauggaucuuaggaaacccagaaugcggauuacugauuuccaaggagucaugguccuacauuguagaaaaaccaaacccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggagaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggggugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33681 - RNA, 1701 nt, Artificial Sequence
  hemagglutinin__InfluenzaA__ACU80102
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33682 - RNA, 1701 nt, Artificial Sequence
  hemagglutinin__InfluenzaA__ACU80113
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaaucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaaaauuggauccuauggauuuccuuugccauaucauguuuuuugcuuugcauugcuuuguugggguucaucaugugggccugccaaaaaggcaacauuaggugcaacauuugcauuuga

SEQ ID NO: 33683 - RNA, 1701 nt, Artificial Sequence
  hemagglutinin__InfluenzaA__ACU80135
augaagacuaucauugcuuugagcuacauucuaugucugguuuucgcucaaaaauuuccuggaaaugacaacagcacggcaacgcugugccuugggcaccaugcaguaccaaacggaacgauggugaaaacaaucacgaaugaccaaauugaaguuacuaaugcuacugagcugguucagaguuccucaacaggugaaauaugcgacaguccucaucagauccuugauggggaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33684 - RNA, 1701 nt, Artificial Sequence
  hemagglutinin__InfluenzaA__ACU80146
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaaaucaggauacaaagauuggauccuauggauuuccuuugccauaucauguuuuuugcuuuguguugcuuuguugggguuaaucaugugggccugccaaaaaggcaacauuaggugcaacauuugcauuuga

SEQ ID NO: 33685 - RNA, 1701 nt, Artificial Sequence; identical to SEQ ID NO: 33027
  hemagglutinin__InfluenzaA__ACU80157

SEQ ID NO: 33686 - RNA, 1698 nt, Artificial Sequence
  hemagglutinin__InfluenzaA__ACU80168
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaaugggaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33687 - RNA, 1701 nt, Artificial Sequence
  hemagglutinin__InfluenzaA__ACU80179
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccuguauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33688 - RNA, 1701 nt, Artificial Sequence
  hemagglutinin__InfluenzaA__ACU80190
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcauugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33689 - RNA, 1701 nt, Artificial Sequence
  hemagglutinin__InfluenzaA__ACU80201
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggaauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 33690 - RNA, 1701 nt, Artificial Sequence; identical to SEQ ID NO: 33021
  hemagglutinin__InfluenzaA__ACU80212

SEQ ID NO: 33691 - RNA, 1698 nt, Artificial Sequence
  hemagglutinin__InfluenzaA__ACU80234
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacaaaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33692 - RNA, 1701 nt, Artificial Sequence
  hemagglutinin__InfluenzaA__ACU80245
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccaagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcagaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaagauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcuuuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33693 - RNA, 1701 nt, Artificial Sequence; identical to SEQ ID NO: 33061
  hemagglutinin__InfluenzaA__ACU80256

SEQ ID NO: 33694 - RNA, 1698 nt, Artificial Sequence
  hemagglutinin__InfluenzaA__ACU80267
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccacaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucaccgcagugggcaaagaauucaacaaauuggaaagaaggauggaaaacuugaauaaaaaaguugaugauggguuuauagacauuuggacauauaaugcagaacuguugguucuacuggaaaacgaaaggacuuuggauuuccaugacuccaaugugaagaaucuguaugagaaaguaaaaagccaguuaaagaauaaugcuaaagaaauaggaaauggguguuuugaguucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33695 - RNA, 1698 nt, Artificial Sequence; identical to SEQ ID NO: 33674
  hemagglutinin__InfluenzaA__ACU80278

SEQ ID NO: 33696 - RNA, 1701 nt, Artificial Sequence; identical to SEQ ID NO: 33021
  hemagglutinin__InfluenzaA__ACU80289

SEQ ID NO: 33697 - RNA, 1701 nt, Artificial Sequence; identical to SEQ ID NO: 33061
  hemagglutinin__InfluenzaA__ACU80300

SEQ ID NO: 33698 - RNA, 1701 nt, Artificial Sequence
  hemagglutinin__InfluenzaA__ACU80311
augaggacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33699 - RNA, 1701 nt, Artificial Sequence; identical to SEQ ID NO: 33681
  hemagglutinin__InfluenzaA__ACU80322

SEQ ID NO: 33700 - RNA, 1701 nt, Artificial Sequence; identical to SEQ ID NO: 33027
  hemagglutinin__InfluenzaA__ACU80333

SEQ ID NO: 33701 - RNA, 1701 nt, Artificial Sequence; identical to SEQ ID NO: 33061
  hemagglutinin__InfluenzaA__ACU80344

SEQ ID NO: 33702 - RNA, 1701 nt, Artificial Sequence
  hemagglutinin__InfluenzaA__ACU80355
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguccaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33703 - RNA, 1701 nt, Artificial Sequence; identical to SEQ ID NO: 33061
  hemagglutinin__InfluenzaA__ACU80366

SEQ ID NO: 33704 - RNA, 1701 nt, Artificial Sequence
  hemagglutinin__InfluenzaA__ACU80377
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauuuugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaggaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccaugucauguuuuuugcuuugcauugcuuuguugggguucaucaugugggccugccaaaaaggcaacauuaggugcaacauuugcauuuga

SEQ ID NO: 33705 - RNA, 1701 nt, Artificial Sequence
  hemagglutinin__InfluenzaA__ACU80388
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaccucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33706 - RNA, 1701 nt, Artificial Sequence; identical to SEQ ID NO: 33027
  hemagglutinin__InfluenzaA__ACU80399

SEQ ID NO: 33707 - RNA, 1698 nt, Artificial Sequence
  hemagglutinin__InfluenzaA__ACU80410
augaaaguaaaacuacugguccuguuaugcacauuuacagcuacauaugcagacacaauauguauaggcuaccaugcuaacaacucgaccgacacuguugacacaguacuugaaaagaaugugacaguaacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccauaccguaaccggagugucagcaucaugcucccauaauggagagagcaguuuuuacagaaauuugcuauggcugacggggaagaaugguuuguacccaaaccugagcaaguccuaugcaaacaacaaagaaaaagaaguccuugugcuaugggguguucaucacccgccaaacauaggugaccaaaaggcccucuaucauacagaaaaugcuuaugucucuguagugucuucacauuauagcagaaaauucacuccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33708 - RNA, 1701 nt, Artificial Sequence
  hemagglutinin__InfluenzaA__ACU80424
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauuuugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaggaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33709 - RNA, 1701 nt, Artificial Sequence; identical to SEQ ID NO: 33708
  hemagglutinin__InfluenzaA__ACU80435

SEQ ID NO: 33710 - RNA, 1698 nt, Artificial Sequence
  hemagglutinin__InfluenzaA__ACU80446
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaauggaagucuaucagauucuggcgaucuacucaacagucgccaguucucugguucuuuuggucucccugggggcaaucagcuucuggauguguuccaaugggucuuugcaguguagaauaugcaucuga

SEQ ID NO: 33711 - RNA, 1701 nt, Artificial Sequence
  hemagglutinin__InfluenzaA__ACU80458
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacuaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33712 - RNA, 1701 nt, Artificial Sequence
  hemagglutinin__InfluenzaA__ACU80470
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33713 - RNA, 1701 nt, Artificial Sequence
  hemagglutinin__InfluenzaA__ACU80600
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaacaagaauugggaccuuuuuguugaacgcagcaaagccuacagcaacuguuacccuuaugaugugccagauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33714 - RNA, 1701 nt, Artificial Sequence; identical to SEQ ID NO: 33708
  hemagglutinin__InfluenzaA__ACU80611

SEQ ID NO: 33715 - RNA, 1701 nt, Artificial Sequence; identical to SEQ ID NO: 33061
  hemagglutinin__InfluenzaA__ACU80622

SEQ ID NO: 33716 - RNA, 1701 nt, Artificial Sequence; identical to SEQ ID NO: 33027
  hemagglutinin__InfluenzaA__ACU80633

SEQ ID NO: 33717 - RNA, 1701 nt, Artificial Sequence
  hemagglutinin__InfluenzaA__ACU80644
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33718 - RNA, 1701 nt, Artificial Sequence
  hemagglutinin__InfluenzaA__ACU80655
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33719 - RNA, 1701 nt, Artificial Sequence
  hemagglutinin__InfluenzaA__ACU80666
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagaucgaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33720 - RNA, 1701 nt, Artificial Sequence
  hemagglutinin__InfluenzaA__ACU80677
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaauuccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacuuugaaauuggcaacagggaugcgaaauguaccagagaaacaaacuagaggcauauuuggcgcaaucgcggguuucauagaaaaugguugggaaggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauccaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33721 - RNA, 1701 nt, Artificial Sequence
  hemagglutinin__InfluenzaA__ACU80688
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacugauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33722 - RNA, 1701 nt, Artificial Sequence; identical to SEQ ID NO: 33061
  hemagglutinin__InfluenzaA__ACU80699

SEQ ID NO: 33723 - RNA, 1701 nt, Artificial Sequence; identical to SEQ ID NO: 33061
  hemagglutinin__InfluenzaA__ACU80710

SEQ ID NO: 33724 - RNA, 1701 nt, Artificial Sequence
  hemagglutinin__InfluenzaA__ACU80721
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaacugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaccucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33725 - RNA, 1701 nt, Artificial Sequence; identical to SEQ ID NO: 33040
  hemagglutinin__InfluenzaA__ACU80732

SEQ ID NO: 33726 - RNA, 1701 nt, Artificial Sequence
  hemagglutinin__InfluenzaA__ACU80743
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacuaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33727 - RNA, 1701 nt, Artificial Sequence
  hemagglutinin__InfluenzaA__ACU80754
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 33728 - RNA, 1701 nt, Artificial Sequence
  hemagglutinin__InfluenzaA__ACU80765
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcggaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaaaucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 33729 - RNA, 1701 nt, Artificial Sequence
  hemagglutinin__InfluenzaA__ACU80787
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33730 - RNA, 1701 nt, Artificial Sequence; identical to SEQ ID NO: 33066
  hemagglutinin__InfluenzaA__ACU80798

SEQ ID NO: 33731 - RNA, 1701 nt, Artificial Sequence
  hemagglutinin__InfluenzaA__ACU81103
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33732 - RNA, 1701 nt, Artificial Sequence
  hemagglutinin__InfluenzaA__ACU87270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33733 - RNA, 1701 nt, Artificial Sequence
  hemagglutinin__InfluenzaA__ACV04228
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuugaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33734 - RNA, 1701 nt, Artificial Sequence; identical to SEQ ID NO: 33173
  hemagglutinin__InfluenzaA__ACV04238

SEQ ID NO: 33735 - RNA, 1701 nt, Artificial Sequence
  hemagglutinin__InfluenzaA__ACV04248
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33736 - RNA, 1701 nt, Artificial Sequence; identical to SEQ ID NO: 33173
  hemagglutinin__InfluenzaA__ACV04258

SEQ ID NO: 33737 - RNA, 1701 nt, Artificial Sequence; identical to SEQ ID NO: 33173
  hemagglutinin__InfluenzaA__ACV04268

SEQ ID NO: 33738 - RNA, 1701 nt, Artificial Sequence; identical to SEQ ID NO: 33173
  hemagglutinin__InfluenzaA__ACV04278

SEQ ID NO: 33739 - RNA, 1701 nt, Artificial Sequence; identical to SEQ ID NO: 33173
  hemagglutinin__InfluenzaA__ACV04288

SEQ ID NO: 33740 - RNA, 1701 nt, Artificial Sequence
  hemagglutinin__InfluenzaA__ACV04298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccggucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33741 - RNA, 1701 nt, Artificial Sequence; identical to SEQ ID NO: 33387
  hemagglutinin__InfluenzaA__ACV04308

SEQ ID NO: 33742 - RNA, 1701 nt, Artificial Sequence
  hemagglutinin__InfluenzaA__ACV04318
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33743 - RNA, 1701 nt, Artificial Sequence; identical to SEQ ID NO: 33173
  hemagglutinin__InfluenzaA__ACV04328

SEQ ID NO: 33744 - RNA, 1701 nt, Artificial Sequence; identical to SEQ ID NO: 33173
  hemagglutinin__InfluenzaA__ACV04338

SEQ ID NO: 33745 - RNA, 1701 nt, Artificial Sequence; identical to SEQ ID NO: 33457
  hemagglutinin__InfluenzaA__ACV04358

SEQ ID NO: 33746 - RNA, 1701 nt, Artificial Sequence
  hemagglutinin__InfluenzaA__ACV04368
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugccaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33747 - RNA, 1701 nt, Artificial Sequence
  hemagglutinin__InfluenzaA__ACV04378
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 33748 - RNA, 1701 nt, Artificial Sequence; identical to SEQ ID NO: 33457
  hemagglutinin__InfluenzaA__ACV04388

SEQ ID NO: 33749 - RNA, 1701 nt, Artificial Sequence; identical to SEQ ID NO: 33206
  hemagglutinin__InfluenzaA__ACV04398

SEQ ID NO: 33750 - RNA, 1701 nt, Artificial Sequence; identical to SEQ ID NO: 33417
  hemagglutinin__InfluenzaA__ACV04408

SEQ ID NO: 33751 - RNA, 1701 nt, Artificial Sequence; identical to SEQ ID NO: 33173
  hemagglutinin__InfluenzaA__ACV04489

SEQ ID NO: 33752 - RNA, 1701 nt, Artificial Sequence; identical to SEQ ID NO: 33173
  hemagglutinin__InfluenzaA__ACV04499

SEQ ID NO: 33753 - RNA, 1701 nt, Artificial Sequence
  hemagglutinin__InfluenzaA__ACV04509
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33754 - RNA, 1701 nt, Artificial Sequence; identical to SEQ ID NO: 33173
  hemagglutinin__InfluenzaA__ACV04519

SEQ ID NO: 33755 - RNA, 1701 nt, Artificial Sequence
  hemagglutinin__InfluenzaA__ACV04529
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33756 - RNA, 1701 nt, Artificial Sequence; identical to SEQ ID NO: 33173
  hemagglutinin__InfluenzaA__ACV04549

SEQ ID NO: 33757 - RNA, 1701 nt, Artificial Sequence
  hemagglutinin__InfluenzaA__ACV04559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33758 - RNA, 1701 nt, Artificial Sequence; identical to SEQ ID NO: 33173
  hemagglutinin__InfluenzaA__ACV04579

SEQ ID NO: 33759 - RNA, 1701 nt, Artificial Sequence
  hemagglutinin__InfluenzaA__ACV04751
auggaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccuuugcguuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacaguaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaauaccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33760 - RNA, 1701 nt, Artificial Sequence
  hemagglutinin__InfluenzaA__ACV04752
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccuggaaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguucuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33761 - RNA, 1701 nt, Artificial Sequence
  hemagglutinin__InfluenzaA__ACV04753
auggaggcaauacuaguaguucugcuauauacauuugcaaccgcaaaugcagacacuuuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguuuuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33762 - RNA, 1701 nt, Artificial Sequence
  hemagglutinin__InfluenzaA__ACV04754
auggaggcaauacuaguaguucugcuauauacauuugcaaccgcaaaugcagacacauuauguauagguuaucaugcgaacaauucaacagacacuguagacacaguacuagaaaagaauguaccaguaacacacucuguuaaccuucuaaaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugaaucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcguauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33763 - RNA, 1701 nt, Artificial Sequence; identical to SEQ ID NO: 33658
  hemagglutinin__InfluenzaA__ACV04755

SEQ ID NO: 33764 - RNA, 1701 nt, Artificial Sequence
  hemagglutinin__InfluenzaA__ACV33084
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacagagucucuaucagaaugcagaugcauauguauuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33765 - RNA, 1701 nt, Artificial Sequence
  hemagglutinin__InfluenzaA__ACV33094
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauucuggcgaucuauucaacugucgccaguucauugguacugguagucucccugggggcaaucaguuucuggaugugcucuaaugggucucuacaguguagaauauguauuuaa

SEQ ID NO: 33766 - RNA, 1701 nt, Artificial Sequence; identical to SEQ ID NO: 33173
  hemagglutinin__InfluenzaA__ACV33104

SEQ ID NO: 33767 - RNA, 1701 nt, Artificial Sequence; identical to SEQ ID NO: 33173
  hemagglutinin__InfluenzaA__ACV33114

SEQ ID NO: 33768 - RNA, 1701 nt, Artificial Sequence
  hemagglutinin__InfluenzaA__ACV33124
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33769 - RNA, 1701 nt, Artificial Sequence; identical to SEQ ID NO: 33768
  hemagglutinin__InfluenzaA__ACV33134

SEQ ID NO: 33770 - RNA, 1701 nt, Artificial Sequence; identical to SEQ ID NO: 33735
  hemagglutinin__InfluenzaA__ACV33144

SEQ ID NO: 33771 - RNA, 1701 nt, Artificial Sequence
  hemagglutinin__InfluenzaA__ACV33154
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33772 - RNA, 1701 nt, Artificial Sequence; identical to SEQ ID NO: 33173
  hemagglutinin__InfluenzaA__ACV33164

SEQ ID NO: 33773 - RNA, 1701 nt, Artificial Sequence; identical to SEQ ID NO: 33173
  hemagglutinin__InfluenzaA__ACV33174

SEQ ID NO: 33774 - RNA, 1701 nt, Artificial Sequence
  hemagglutinin__InfluenzaA__ACV41981
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaacuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33775 - RNA, 1701 nt, Artificial Sequence; identical to SEQ ID NO: 33239
  hemagglutinin__InfluenzaA__ACV41991

SEQ ID NO: 33776 - RNA, 1701 nt, Artificial Sequence; identical to SEQ ID NO: 33239
  hemagglutinin__InfluenzaA__ACV42001

SEQ ID NO: 33777 - RNA, 1701 nt, Artificial Sequence; identical to SEQ ID NO: 33472
  hemagglutinin__InfluenzaA__ACV42008

SEQ ID NO: 33778 - RNA, 1701 nt, Artificial Sequence; identical to SEQ ID NO: 33173
  hemagglutinin__InfluenzaA__ACV42018

SEQ ID NO: 33779 - RNA, 1701 nt, Artificial Sequence; identical to SEQ ID NO: 32820
  hemagglutinin__InfluenzaA__ACV49501

SEQ ID NO: 33780 - RNA, 1701 nt, Artificial Sequence
  hemagglutinin__InfluenzaA__ACV49512
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagauguugaacugaagucuggauacaaagacuggauccuguggauuuccuuugccauaucaugcuuuuugcuuuguguuguuuugcugggguuuaucaugugggccugccagagaggcaacauuaggugcaacauuugcauuuga

SEQ ID NO: 33781 - RNA, 1701 nt, Artificial Sequence; identical to SEQ ID NO: 32911
  hemagglutinin__InfluenzaA__ACV49523

SEQ ID NO: 33782 - RNA, 1698 nt, Artificial Sequence
  hemagglutinin__InfluenzaA__ACV49545
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 33783 - RNA, 1701 nt, Artificial Sequence
  hemagglutinin__InfluenzaA__ACV49556
augaaggcaagacuacugauccuguugugugcacuugcagcuacagaugcagacacaauauguauaggcuaccaugcgaacaauucaaccgacacuguugacacaguacucgagaagaaugugacagugacacacucuguuaaccugcucgaagacagccacaacgggaaacuauguagauuaaaaggaauagccccauuacaauuggggaaauguaacaucgccggauggaucuugggaaacccagaaugcgacucauugcuuccagcgaguucaugguccuacauuguagaaacaccaaacucuaagaauggaauauguuauccaggagauuucaucgacuaugaggaacugagggagcaauugagcucaguaucaucauucgaaagauucgaaauauuucccaaggaaagcucauggcccaaacacagcacaaccaaaggaguaacggcagcaugcucccaugcaggaaagagcaguuuuuacagaaauuugcuauggcugacgaagaaggaggacucauacccaaagcugagcaauuccuaugugaacaagaaagggaaagaaguccuuguacuaugggguguucaucacccgucuagcaguaaagagcaacagacucucuaucagaaugaaaaugcuuaugucucuguagugucuucaaauuauaacaggagauucaucccggaaauagcagaaagacccgaaguaaaagaucaagcugggaggauaaacuauuacuggaccuugcuagaacccggagacacaauaauauuugaggcuaauggaaaucuaguagcaccaugguaugcuuucgcacugaguagaggcuuuggguccggcaucaucaccucaaacgcaucaaugcaugaguguaacacgaagugucaaacaccccagggagcuauaaacagcagucucccuuuccagaauauacacccagucacaauaggagagugcccaaaauacgucaagagugccaaauugaggaugguuacaggacuaagaaacaucccauccauucaauccaggggucuauuuggagccauugccgguuuuauugaaggaggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacugcuguggguaaagaauucaacaacuuagaaaaaaggauggaaaauuuaaauaaaaaaguugaugauggauuccuggacauuuggacguauaaugcagaauuguuaguucuacuggaaaaugaaagaacucuggauuuccaugacucaaaugugaaaaaucuguaugagaaaguaaaaauccaauuaaagaauaaugccaaagaaaucggaaauggguguuuugaguucuaccacaagugugacaaugaaugcauggaaagugugagaaaugggacuuaugauuauccaaaauauucaaaagaaucaaaguugaacagggaaaagauagauggagugaaauuggaaucaaugggggucuaucagauucuggcgaucuacucaacugucgccaguucacuggugcuuuuggucucccugggggcaaucaguuucuggauguguucuaaugggucuuugcagugcagaauaugcaucuga

SEQ ID NO: 33784 - RNA, 1701 nt, Artificial Sequence
  hemagglutinin__InfluenzaA__ACV49567
augaaagcaaaacuacugauccuguuaugugcacuuacagcuacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggagcauguuacccaggagauuucgccgacuaugaggaacugagggagcaauugagcucagugucaucauucgagagauucgaaauauuccccaaggaaagaucauggcccaaacacaacauaaccagaggaguaacggcagcaugcucccaugcggggaaaagcaguuuuuacaaaaauuugcucuggcugacggagacagauggcucauacccaaagcugagcaaguccuaugugaacaauaaagagaaagaaguccuugugcuaugggguguucaucacccgucuaacauagaggaucaaaagacccucuaucggaaagaaaaugcuuaugucucuguagugucuucaaauuauaacaggagauucaccccggaaauagcagaaagacccaaaguaagaggucaagcagggagaauuaacuauuacuggacuuugcuagaacccggagacacaauaauauuugaggcaaauggaaaucuaauagcgccaugguaugcuuucgcacugaguagagacuuuggaucaggaaucaucaccucaaacgcaucaauggaugaaugugacacgaagugucaaacaccccagggagcuauaaacaguagucucccuuuucagaauauacacccagucacaauaggagagugcccaaaauacgucaagaguaccaaauugaggaugguuacaggauuaaggaacaucccauccauucaauccagaggucuguuuggagccauugccgguuucauugaggggggauggacuggaaugauagauggaugguaugguuaccaucaucagaaugaacagggaucuggcuaugcugcggaucaaaaaagcacacaaaaugcaauuaacuggauuacaaauaaggugaacucuguuaucgagaaaaugaacacucaauucacagcuguggguaaagaauucaacaaauuagaaaaaagaauggaaaacuuaaauaaaaaaguugaugauggguuucuggacauuuggacauauaaugcagaauuguugguucuacuggaaaaugaaaggacuuuggauuuccaugacucaaaugugaagaaucuguaugagaaaguaaaaaaccaauuaaggaauaaugcaaaggaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcaaugcagaauaugcaucuga

SEQ ID NO: 33785 - RNA, 1689 nt, Artificial Sequence
  hemagglutinin__InfluenzaA__ACV49578
auggccaucauuuaucucauacuccuguucacagcagugaggggggaccagauaugcauuggauaccaugccaauaauuccacagaaaaggucgacacaauccuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgaaauacaguuuguguuacccaggcagcuucaaugacuaugaagaauugaaacaucuccucagcagcguaaaacauuucgagaaaguaaagauucugcccaaagauagauggacacagcauacaacaacuggagguucaagggccugcgcggugucagguaacccaucauucuucaggaacauggucuggcugacaaagaaaggaccaaauuauccgguugccaaaggaucguacaacaauacgagcggagaacaaaugcuaauaauuuggggagugcaccauccuauugaugaggcagaacaaauagcauuguaccagaaagugggaaccuauguuucugcaagcacaucaacauugaacaaaaggucaaccccagaaauagcagcaaggccugaagugaauggacuaggaaguagaauggaauucucuuggacccucuuggauaugugggacaccauaaauuuugagagcacugguaaucuaguugcaccagaguauggauucaaaauaucgaaaagagguaguucagggaucaugaagacagaaggaacacuugagaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagaaaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacgaugaaugcauggauagugugaaaaacgggacguaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 33786 - RNA, 1689 nt, Artificial Sequence; identical to SEQ ID NO: 33785
  hemagglutinin__InfluenzaA__ACV49589

SEQ ID NO: 33787 - RNA, 1689 nt, Artificial Sequence
  hemagglutinin__InfluenzaA__ACV49600
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacagagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 33788 - RNA, 1689 nt, Artificial Sequence
  hemagglutinin__InfluenzaA__ACV49611
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacagagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccaaaaauagcaacaaggccuaaagugaauggacaaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagguggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 33789 - RNA, 1701 nt, Artificial Sequence
  hemagglutinin__InfluenzaA__ACV49633
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggagugggaccuuuuuguugaacgcagcaaagcuuacagcaacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacaguguccaaaccagccuauauguucaagcaucagggagagucacagucucuaccaaaagaagccaacaaacuguaaucccgaauaucgggucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauucccucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33790 - RNA, 1701 nt, Artificial Sequence; identical to SEQ ID NO: 32860
  hemagglutinin__InfluenzaA__ACV49644

SEQ ID NO: 33791 - RNA, 1698 nt, Artificial Sequence; identical to SEQ ID NO: 33679
  hemagglutinin__InfluenzaA__ACV49676

SEQ ID NO: 33792 - RNA, 1701 nt, Artificial Sequence
  hemagglutinin__InfluenzaA__ACV53450
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacagagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33793 - RNA, 1701 nt, Artificial Sequence; identical to SEQ ID NO: 33168
  hemagglutinin__InfluenzaA__ACV53460

SEQ ID NO: 33794 - RNA, 1701 nt, Artificial Sequence; identical to SEQ ID NO: 33570
  hemagglutinin__InfluenzaA__ACV53480

SEQ ID NO: 33795 - RNA, 1701 nt, Artificial Sequence
  hemagglutinin__InfluenzaA__ACV53490
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugugacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaacaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33796 - RNA, 1701 nt, Artificial Sequence
  hemagglutinin__InfluenzaA__ACV53500
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaacaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33797 - RNA, 1701 nt, Artificial Sequence
  hemagglutinin__InfluenzaA__ACV53880
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33798 - RNA, 1701 nt, Artificial Sequence; identical to SEQ ID NO: 33206
  hemagglutinin__InfluenzaA__ACV53881

SEQ ID NO: 33799 - RNA, 1701 nt, Artificial Sequence; identical to SEQ ID NO: 33197
  hemagglutinin__InfluenzaA__ACV53882

SEQ ID NO: 33800 - RNA, 1701 nt, Artificial Sequence
  hemagglutinin__InfluenzaA__ACV53883
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33801 - RNA, 1701 nt, Artificial Sequence
  hemagglutinin__InfluenzaA__ACV53885
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33802 - RNA, 1701 nt, Artificial Sequence
  hemagglutinin__InfluenzaA__ACV53899
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33803 - RNA, 1701 nt, Artificial Sequence
  hemagglutinin__InfluenzaA__ACV53909
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33804 - RNA, 1701 nt, Artificial Sequence
  hemagglutinin__InfluenzaA__ACV67220
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33805 - RNA, 1701 nt, Artificial Sequence
  hemagglutinin__InfluenzaA__ACV67221
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagagugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33806 - RNA, 1701 nt, Artificial Sequence; identical to SEQ ID NO: 33197
  hemagglutinin__InfluenzaA__ACV67222

SEQ ID NO: 33807 - RNA, 1701 nt, Artificial Sequence; identical to SEQ ID NO: 33239
  hemagglutinin__InfluenzaA__ACV67223

SEQ ID NO: 33808 - RNA, 1701 nt, Artificial Sequence; identical to SEQ ID NO: 33457
  hemagglutinin__InfluenzaA__ACV67224

SEQ ID NO: 33809 - RNA, 1701 nt, Artificial Sequence; identical to SEQ ID NO: 33390
  hemagglutinin__InfluenzaA__ACV67225

SEQ ID NO: 33810 - RNA, 1701 nt, Artificial Sequence
  hemagglutinin__InfluenzaA__ACV67226
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagagauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33811 - RNA, 1701 nt, Artificial Sequence
  hemagglutinin__InfluenzaA__ACV67227
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucaaauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33812 - RNA, 1701 nt, Artificial Sequence; identical to SEQ ID NO: 33457
  hemagglutinin__InfluenzaA__ACV67228

SEQ ID NO: 33813 - RNA, 1701 nt, Artificial Sequence
  hemagglutinin__InfluenzaA__ACV67229
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaucccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33814 - RNA, 1701 nt, Artificial Sequence
  hemagglutinin__InfluenzaA__ACV67230
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaaggcccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33815 - RNA, 1701 nt, Artificial Sequence; identical to SEQ ID NO: 33173
  hemagglutinin__InfluenzaA__ACV67231

SEQ ID NO: 33816 - RNA, 1701 nt, Artificial Sequence
  hemagglutinin__InfluenzaA__ACV67232
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 33817 - RNA, 1701 nt, Artificial Sequence; identical to SEQ ID NO: 33449
  hemagglutinin__InfluenzaA__ACV67233

SEQ ID NO: 33818 - RNA, 1701 nt, Artificial Sequence
  hemagglutinin__InfluenzaA__ACV67234
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuaaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33819 - RNA, 1701 nt, Artificial Sequence
  hemagglutinin__InfluenzaA__ACV67235
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaugaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33820 - RNA, 1701 nt, Artificial Sequence; identical to SEQ ID NO: 33417
  hemagglutinin__InfluenzaA__ACV67236

SEQ ID NO: 33821 - RNA, 1701 nt, Artificial Sequence
  hemagglutinin__InfluenzaA__ACV67238
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuggugcugguagucucccugggggcaaucaguuucuggaugugcucuaaugggucucuacaguguagaauauguauuuaa

SEQ ID NO: 33822 - RNA, 1701 nt, Artificial Sequence
  hemagglutinin__InfluenzaA__ACV67239
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33823 - RNA, 1701 nt, Artificial Sequence; identical to SEQ ID NO: 33417
  hemagglutinin__InfluenzaA__ACV67240

SEQ ID NO: 33824 - RNA, 1701 nt, Artificial Sequence
  hemagglutinin__InfluenzaA__ACV67241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaauggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33825 - RNA, 1701 nt, Artificial Sequence; identical to SEQ ID NO: 33457
  hemagglutinin__InfluenzaA__ACV67242

SEQ ID NO: 33826 - RNA, 1701 nt, Artificial Sequence
  hemagglutinin__InfluenzaA__ACV67244
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33827 - RNA, 1701 nt, Artificial Sequence
  hemagglutinin__InfluenzaA__ACV67246
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaaggcccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33828 - RNA, 1701 nt, Artificial Sequence; identical to SEQ ID NO: 33797
  hemagglutinin__InfluenzaA__ACV67247

SEQ ID NO: 33829 - RNA, 1701 nt, Artificial Sequence; identical to SEQ ID NO: 33197
  hemagglutinin__InfluenzaA__ACV70073

SEQ ID NO: 33830 - RNA, 1701 nt, Artificial Sequence; identical to SEQ ID NO: 33197
  hemagglutinin__InfluenzaA__ACV70093

SEQ ID NO: 33831 - RNA, 1701 nt, Artificial Sequence; identical to SEQ ID NO: 33197
  hemagglutinin__InfluenzaA__ACV70103

SEQ ID NO: 33832 - RNA, 1701 nt, Artificial Sequence; identical to SEQ ID NO: 33197
  hemagglutinin__InfluenzaA__ACV70113

SEQ ID NO: 33833 - RNA, 1701 nt, Artificial Sequence; identical to SEQ ID NO: 33197
  hemagglutinin__InfluenzaA__ACV70123

SEQ ID NO: 33834 - RNA, 1701 nt, Artificial Sequence; identical to SEQ ID NO: 33197
  hemagglutinin__InfluenzaA__ACV70154

SEQ ID NO: 33835 - RNA, 1701 nt, Artificial Sequence
  hemagglutinin__InfluenzaA__ACV70164
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33836 - RNA, 1701 nt, Artificial Sequence; identical to SEQ ID NO: 33197
  hemagglutinin__InfluenzaA__ACV70174

SEQ ID NO: 33837 - RNA, 1701 nt, Artificial Sequence
  hemagglutinin__InfluenzaA__ACV70184
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33838 - RNA, 1701 nt, Artificial Sequence; identical to SEQ ID NO: 33197
  hemagglutinin__InfluenzaA__ACV70194

SEQ ID NO: 33839 - RNA, 1701 nt, Artificial Sequence
  hemagglutinin__InfluenzaA__ACV70204
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33840 - RNA, 1701 nt, Artificial Sequence; identical to SEQ ID NO: 33168
  hemagglutinin__InfluenzaA__ACV70214

SEQ ID NO: 33841 - RNA, 1701 nt, Artificial Sequence; identical to SEQ ID NO: 33197
  hemagglutinin__InfluenzaA__ACV70224

SEQ ID NO: 33842 - RNA, 1701 nt, Artificial Sequence; identical to SEQ ID NO: 33197
  hemagglutinin__InfluenzaA__ACV70234

SEQ ID NO: 33843 - RNA, 1701 nt, Artificial Sequence
  hemagglutinin__InfluenzaA__ACV70254
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33844 - RNA, 1701 nt, Artificial Sequence
  hemagglutinin__InfluenzaA__ACV70264
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaggugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33845 - RNA, 1701 nt, Artificial Sequence; identical to SEQ ID NO: 33197
  hemagglutinin__InfluenzaA__ACV70274

SEQ ID NO: 33846 - RNA, 1701 nt, Artificial Sequence; identical to SEQ ID NO: 33197
  hemagglutinin__InfluenzaA__ACV70284

SEQ ID NO: 33847 - RNA, 1701 nt, Artificial Sequence; identical to SEQ ID NO: 33197
  hemagglutinin__InfluenzaA__ACV70294

SEQ ID NO: 33848 - RNA, 1701 nt, Artificial Sequence; identical to SEQ ID NO: 33197
  hemagglutinin__InfluenzaA__ACV70304

SEQ ID NO: 33849 - RNA, 1701 nt, Artificial Sequence
  hemagglutinin__InfluenzaA__ACV70314
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33850 - RNA, 1701 nt, Artificial Sequence
  hemagglutinin__InfluenzaA__ACV70324
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuucacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33851 - RNA, 1701 nt, Artificial Sequence; identical to SEQ ID NO: 33197
  hemagglutinin__InfluenzaA__ACV70334

SEQ ID NO: 33852 - RNA, 1701 nt, Artificial Sequence
  hemagglutinin__InfluenzaA__ACV70344
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33853 - RNA, 1701 nt, Artificial Sequence; identical to SEQ ID NO: 33197
  hemagglutinin__InfluenzaA__ACV70354

SEQ ID NO: 33854 - RNA, 1701 nt, Artificial Sequence; identical to SEQ ID NO: 33197
  hemagglutinin__InfluenzaA__ACV70364

SEQ ID NO: 33855 - RNA, 1701 nt, Artificial Sequence; identical to SEQ ID NO: 33197
  hemagglutinin__InfluenzaA__ACV70374

SEQ ID NO: 33856 - RNA, 1701 nt, Artificial Sequence; identical to SEQ ID NO: 33197
  hemagglutinin__InfluenzaA__ACV70384

SEQ ID NO: 33857 - RNA, 1701 nt, Artificial Sequence; identical to SEQ ID NO: 33197
  hemagglutinin__InfluenzaA__ACV70394

SEQ ID NO: 33858 - RNA, 1701 nt, Artificial Sequence; identical to SEQ ID NO: 33197
  hemagglutinin__InfluenzaA__ACV70404

SEQ ID NO: 33859 - RNA, 1701 nt, Artificial Sequence; identical to SEQ ID NO: 33849
  hemagglutinin__InfluenzaA__ACV70414

SEQ ID NO: 33860 - RNA, 1701 nt, Artificial Sequence; identical to SEQ ID NO: 33197
  hemagglutinin__InfluenzaA__ACV70424

SEQ ID NO: 33861 - RNA, 1701 nt, Artificial Sequence; identical to SEQ ID NO: 33197
  hemagglutinin__InfluenzaA__ACV70434

SEQ ID NO: 33862 - RNA, 1701 nt, Artificial Sequence; identical to SEQ ID NO: 33197
  hemagglutinin__InfluenzaA__ACV70444

SEQ ID NO: 33863 - RNA, 1701 nt, Artificial Sequence
  hemagglutinin__InfluenzaA__ACV70454
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33864 - RNA, 1701 nt, Artificial Sequence; identical to SEQ ID NO: 33863
  hemagglutinin__InfluenzaA__ACV70464

SEQ ID NO: 33865 - RNA, 1701 nt, Artificial Sequence; identical to SEQ ID NO: 33197
  hemagglutinin__InfluenzaA__ACV70474

SEQ ID NO: 33866 - RNA, 1701 nt, Artificial Sequence; identical to SEQ ID NO: 33197
  hemagglutinin__InfluenzaA__ACV70484

SEQ ID NO: 33867 - RNA, 1701 nt, Artificial Sequence; identical to SEQ ID NO: 33197
  hemagglutinin__InfluenzaA__ACV70494

SEQ ID NO: 33868 - RNA, 1701 nt, Artificial Sequence; identical to SEQ ID NO: 33197
  hemagglutinin__InfluenzaA__ACV70504

SEQ ID NO: 33869 - RNA, 1701 nt, Artificial Sequence
  hemagglutinin__InfluenzaA__ACV70514
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33870 - RNA, 1701 nt, Artificial Sequence; identical to SEQ ID NO: 33197
  hemagglutinin__InfluenzaA__ACV70524

SEQ ID NO: 33871 - RNA, 1701 nt, Artificial Sequence; identical to SEQ ID NO: 33390
  hemagglutinin__InfluenzaA__ACV70534

SEQ ID NO: 33872 - RNA, 1701 nt, Artificial Sequence; identical to SEQ ID NO: 33197
  hemagglutinin__InfluenzaA__ACV70544

SEQ ID NO: 33873 - RNA, 1701 nt, Artificial Sequence
  hemagglutinin__InfluenzaA__ACV70564
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacaguaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33874 - RNA, 1701 nt, Artificial Sequence; identical to SEQ ID NO: 33197
  hemagglutinin__InfluenzaA__ACV70584

SEQ ID NO: 33875 - RNA, 1701 nt, Artificial Sequence; identical to SEQ ID NO: 33849
  hemagglutinin__InfluenzaA__ACV70594

SEQ ID NO: 33876 - RNA, 1701 nt, Artificial Sequence; identical to SEQ ID NO: 33197
  hemagglutinin__InfluenzaA__ACV70604

SEQ ID NO: 33877 - RNA, 1701 nt, Artificial Sequence; identical to SEQ ID NO: 33197
  hemagglutinin__InfluenzaA__ACV70614

SEQ ID NO: 33878 - RNA, 1701 nt, Artificial Sequence; identical to SEQ ID NO: 33839
  hemagglutinin__InfluenzaA__ACV70624

SEQ ID NO: 33879 - RNA, 1701 nt, Artificial Sequence; identical to SEQ ID NO: 33197
  hemagglutinin__InfluenzaA__ACV70634

SEQ ID NO: 33880 - RNA, 1701 nt, Artificial Sequence; identical to SEQ ID NO: 33197
  hemagglutinin__InfluenzaA__ACV70644

SEQ ID NO: 33881 - RNA, 1701 nt, Artificial Sequence; identical to SEQ ID NO: 33197
  hemagglutinin__InfluenzaA__ACV70654

SEQ ID NO: 33882 - RNA, 1701 nt, Artificial Sequence; identical to SEQ ID NO: 33839
  hemagglutinin__InfluenzaA__ACV70664

SEQ ID NO: 33883 - RNA, 1701 nt, Artificial Sequence; identical to SEQ ID NO: 33197
  hemagglutinin__InfluenzaA__ACV70674

SEQ ID NO: 33884 - RNA, 1701 nt, Artificial Sequence; identical to SEQ ID NO: 33197
  hemagglutinin__InfluenzaA__ACV70684

SEQ ID NO: 33885 - RNA, 1701 nt, Artificial Sequence; identical to SEQ ID NO: 33197
  hemagglutinin__InfluenzaA__ACV70694

SEQ ID NO: 33886 - RNA, 1701 nt, Artificial Sequence
  hemagglutinin__InfluenzaA__ACV70704
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33887 - RNA, 1701 nt, Artificial Sequence; identical to SEQ ID NO: 33197
  hemagglutinin__InfluenzaA__ACV70714

SEQ ID NO: 33888 - RNA, 1701 nt, Artificial Sequence; identical to SEQ ID NO: 33197
  hemagglutinin__InfluenzaA__ACV70724

SEQ ID NO: 33889 - RNA, 1701 nt, Artificial Sequence; identical to SEQ ID NO: 33797
  hemagglutinin__InfluenzaA__ACV70734

SEQ ID NO: 33890 - RNA, 1701 nt, Artificial Sequence; identical to SEQ ID NO: 33197
  hemagglutinin__InfluenzaA__ACV70744

SEQ ID NO: 33891 - RNA, 1701 nt, Artificial Sequence; identical to SEQ ID NO: 33197
  hemagglutinin__InfluenzaA__ACV70754

SEQ ID NO: 33892 - RNA, 1701 nt, Artificial Sequence; identical to SEQ ID NO: 33197
  hemagglutinin__InfluenzaA__ACV70764

SEQ ID NO: 33893 - RNA, 1701 nt, Artificial Sequence; identical to SEQ ID NO: 33197
  hemagglutinin__InfluenzaA__ACV70784

SEQ ID NO: 33894 - RNA, 1701 nt, Artificial Sequence
  hemagglutinin__InfluenzaA__ACV70794
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugcaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33895 - RNA, 1701 nt, Artificial Sequence; identical to SEQ ID NO: 33197
  hemagglutinin__InfluenzaA__ACV70804

SEQ ID NO: 33896 - RNA, 1701 nt, Artificial Sequence; identical to SEQ ID NO: 33849
  hemagglutinin__InfluenzaA__ACV70824

SEQ ID NO: 33897 - RNA, 1701 nt, Artificial Sequence
  hemagglutinin__InfluenzaA__ACV70834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugcccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33898 - RNA, 1701 nt, Artificial Sequence
  hemagglutinin__InfluenzaA__ACV70844
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33899 - RNA, 1701 nt, Artificial Sequence; identical to SEQ ID NO: 33197
  hemagglutinin__InfluenzaA__ACV70854

SEQ ID NO: 33900 - RNA, 1701 nt, Artificial Sequence
  hemagglutinin__InfluenzaA__ACV70864
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaacuucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33901 - RNA, 1701 nt, Artificial Sequence
  hemagglutinin__InfluenzaA__ACV70874
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33902 - RNA, 1701 nt, Artificial Sequence; identical to SEQ ID NO: 33390
  hemagglutinin__InfluenzaA__ACV70884

SEQ ID NO: 33903 - RNA, 1701 nt, Artificial Sequence
  hemagglutinin__InfluenzaA__ACV70904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33904 - RNA, 1701 nt, Artificial Sequence
  hemagglutinin__InfluenzaA__ACV70914
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33905 - RNA, 1701 nt, Artificial Sequence
  hemagglutinin__InfluenzaA__ACV70924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauauagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccuaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucgaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33906 - RNA, 1701 nt, Artificial Sequence; identical to SEQ ID NO: 33197
  hemagglutinin__InfluenzaA__ACV70934

SEQ ID NO: 33907 - RNA, 1701 nt, Artificial Sequence; identical to SEQ ID NO: 33197
  hemagglutinin__InfluenzaA__ACV70944

SEQ ID NO: 33908 - RNA, 1701 nt, Artificial Sequence
  hemagglutinin__InfluenzaA__ACV70954
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33909 - RNA, 1701 nt, Artificial Sequence; identical to SEQ ID NO: 33197
  hemagglutinin__InfluenzaA__ACV70964

SEQ ID NO: 33910 - RNA, 1701 nt, Artificial Sequence; identical to SEQ ID NO: 33197
  hemagglutinin__InfluenzaA__ACV70974

SEQ ID NO: 33911 - RNA, 1701 nt, Artificial Sequence; identical to SEQ ID NO: 33903
  hemagglutinin__InfluenzaA__ACV70984

SEQ ID NO: 33912 - RNA, 1701 nt, Artificial Sequence
  hemagglutinin__InfluenzaA__ACV70994
augaaggcaauacuaguaguucugcuauauacauuugcaaccgcaaaugcagacacauuauguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33913 - RNA, 1701 nt, Artificial Sequence; identical to SEQ ID NO: 33197
  hemagglutinin__InfluenzaA__ACV71004

SEQ ID NO: 33914 - RNA, 1701 nt, Artificial Sequence
  hemagglutinin__InfluenzaA__ACV82230
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagccaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 33915 - RNA, 1701 nt, Artificial Sequence
  hemagglutinin__InfluenzaA__ACV82232
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33916 - RNA, 1698 nt, Artificial Sequence
  hemagglutinin__InfluenzaA__ACV82233
augaaaguaaaacuacugguccuguuaugcacauuuacagcuacauaugcagacacaauauguauaggcuaccaugcuaacaacucgaccgauacuguugacacaguacuugaaaagaaugugacagugacacacucugucaaccugcuugagaacaaucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaauaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33917 - RNA, 1701 nt, Artificial Sequence
  hemagglutinin__InfluenzaA__ACV83662
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33918 - RNA, 1701 nt, Artificial Sequence
  hemagglutinin__InfluenzaA__ACV83663
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33919 - RNA, 1701 nt, Artificial Sequence
  hemagglutinin__InfluenzaA__ACV83664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaggugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33920 - RNA, 1701 nt, Artificial Sequence
  hemagglutinin__InfluenzaA__ACV83665
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuauugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33921 - RNA, 1701 nt, Artificial Sequence
  hemagglutinin__InfluenzaA__ACV83667
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33922 - RNA, 1701 nt, Artificial Sequence
  hemagglutinin__InfluenzaA__ACV83668
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33923 - RNA, 1701 nt, Artificial Sequence
  hemagglutinin__InfluenzaA__ACV83670
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggccuaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33924 - RNA, 1701 nt, Artificial Sequence; identical to SEQ ID NO: 33457
  hemagglutinin__InfluenzaA__ACV83671

SEQ ID NO: 33925 - RNA, 1701 nt, Artificial Sequence
  hemagglutinin__InfluenzaA__ACV88399
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugagaaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33926 - RNA, 1701 nt, Artificial Sequence; identical to SEQ ID NO: 33735
  hemagglutinin__InfluenzaA__ACV88409

SEQ ID NO: 33927 - RNA, 1701 nt, Artificial Sequence; identical to SEQ ID NO: 33582
  hemagglutinin__InfluenzaA__ACV88419

SEQ ID NO: 33928 - RNA, 1698 nt, Artificial Sequence; identical to SEQ ID NO: 33782
  hemagglutinin__InfluenzaA__ACV89502

SEQ ID NO: 33929 - RNA, 1701 nt, Artificial Sequence
  hemagglutinin__InfluenzaA__ACV89516
augaaggcaagacuacugauccuguugugugcacuugcagcuacagaugcagacacaauauguauaggcuaccaugcgaacaauucaaccgacacuguugacacaguacucgagaagaaugugacagugacacacucuguuaaccugcucgaagacagccacaacgggaaacuauguagauuaaaaggaauagccccauuacaauuggggaaauguaacaucgccggauggaucuugggaaacccagaaugcgacucauugcuuccagcgaguucaugguccuacauuguagaaacaccaaacucuaagaauggaauauguuauccaggagauuucaucgacuaugaggaacugagggagcaauugagcucaguaucaucauucgaaagauucgaaauauuucccaaggaaagcucauggcccaaacacagcacaaccaaaggaguaacggcagcaugcucccaugcaggaaagagcaguuuuuacagaaauuugcuauggcugacgaagaagggggacucauacccaaagcugagcaauuccuaugugaacaagaaagggaaagaaguccuuguacuaugggguguucaucacccgucuagcaguaaagagcaacagacucucuaucagaaugaaaaugcuuaugucucuguagugucuucaaauuauaacaggagauucaucccggaaauagcagaaagacccgaaguaaaagaucaagcugggaggauaaacuauuacuggaccuugcuagaacccggagacacaauaauauuugaggcuaauggaaaucuaguagcaccaugguaugcuuucgcacugaguagaggcuuuggguccggcaucaucaccucaaacgcaucaaugcaugaguguaacacgaagugucaaacaccccagggagcuauaaacagcagucucccuuuccagaauauacacccagucacaauaggagagugcccaaaauacgucaagagugccaaauugaggaugguuacaggacuaagaaacaucccauccauucaauccaggggucuauuuggagccauugccgguuuuauugaaggaggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacugcuguggguaaagaauucaacaacuuagaaaaaaggauggaaaauuuaaauaaaaaaguugaugauggauuccuggacauuuggacguauaaugcagaauuguuaguucuacuggaaaaugaaagaacucuggauuuccaugacucaaaugugaaaaaucuguaugagaaaguaaaaauccaauuaaagaauaaugccaaagaaaucggaaauggguguuuugaguucuaccacaagugugacaaugaaugcauggaaagugugagaaaugggacuuaugauuauccaaaauauucaaaagaaucaaaguugaacagggaaaagauagauggagugaaauuggaaucaaugggggucuaucagauucuggcgaucuacucaacugucgccaguucacuggugcuuuuggucucccugggggcaaucaguuucuggauguguucuaaugggucuuugcagugcagaauaugcaucuga

SEQ ID NO: 33930 - RNA, 1698 nt, Artificial Sequence
  hemagglutinin__InfluenzaA__ACV90512
augaacguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauugauaaaugggaugcgaagugccaaacaccucagggagcuauaaacagcagucuuccuuuccagaacguacacccagucacaauaggagaguggccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaauggaauuacaaacaagaugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugacauuggaaucaaugggagucuaucagauuuuggcgaucuacucaacagucgccaguucucugguucucuuggucucccugggggcaaucagcuucuggauguguuccaaugggucuuugcaguguagaauaugcaucuga

SEQ ID NO: 33931 - RNA, 1701 nt, Artificial Sequence
  hemagglutinin__InfluenzaA__ACV91672
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33932 - RNA, 1701 nt, Artificial Sequence
  hemagglutinin__InfluenzaA__ACV91676
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33933 - RNA, 1701 nt, Artificial Sequence
  hemagglutinin__InfluenzaA__ACV91680
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagaacaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33934 - RNA, 1701 nt, Artificial Sequence
  hemagglutinin__InfluenzaA__ACX31591
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauaccaagcauugaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33935 - RNA, 1701 nt, Artificial Sequence
  hemagglutinin__InfluenzaA__ACX31933
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauaaaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33936 - RNA, 1701 nt, Artificial Sequence
  hemagglutinin__InfluenzaA__ACX31934
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaacaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33937 - RNA, 1701 nt, Artificial Sequence
  hemagglutinin__InfluenzaA__ACX31935
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33938 - RNA, 1701 nt, Artificial Sequence; identical to SEQ ID NO: 33173
  hemagglutinin__InfluenzaA__ACX31936

SEQ ID NO: 33939 - RNA, 1701 nt, Artificial Sequence
  hemagglutinin__InfluenzaA__ACX31939
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuacgacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33940 - RNA, 1701 nt, Artificial Sequence; identical to SEQ ID NO: 33939
  hemagglutinin__InfluenzaA__ACX31940

SEQ ID NO: 33941 - RNA, 1701 nt, Artificial Sequence; identical to SEQ ID NO: 33173
  hemagglutinin__InfluenzaA__ACX31943

SEQ ID NO: 33942 - RNA, 1701 nt, Artificial Sequence; identical to SEQ ID NO: 33173
  hemagglutinin__InfluenzaA__ACX31946

SEQ ID NO: 33943 - RNA, 1701 nt, Artificial Sequence; identical to SEQ ID NO: 33173
  hemagglutinin__InfluenzaA__ACX31947

SEQ ID NO: 33944 - RNA, 1701 nt, Artificial Sequence
  hemagglutinin__InfluenzaA__ACX31948
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33945 - RNA, 1701 nt, Artificial Sequence
  hemagglutinin__InfluenzaA__ACX31949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacuauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaagagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33946 - RNA, 1701 nt, Artificial Sequence
  hemagglutinin__InfluenzaA__ACX31950
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33947 - RNA, 1701 nt, Artificial Sequence; identical to SEQ ID NO: 33173
  hemagglutinin__InfluenzaA__ACX31951

SEQ ID NO: 33948 - RNA, 1701 nt, Artificial Sequence; identical to SEQ ID NO: 33523
  hemagglutinin__InfluenzaA__ACX31954

SEQ ID NO: 33949 - RNA, 1701 nt, Artificial Sequence; identical to SEQ ID NO: 33173
  hemagglutinin__InfluenzaA__ACX31955

SEQ ID NO: 33950 - RNA, 1701 nt, Artificial Sequence; identical to SEQ ID NO: 33168
  hemagglutinin__InfluenzaA__ACX31956

SEQ ID NO: 33951 - RNA, 1701 nt, Artificial Sequence
  hemagglutinin__InfluenzaA__ACX31957
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaucauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33952 - RNA, 1701 nt, Artificial Sequence
  hemagglutinin__InfluenzaA__ACX31958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaaguuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33953 - RNA, 1701 nt, Artificial Sequence; identical to SEQ ID NO: 33457
  hemagglutinin__InfluenzaA__ACX31960

SEQ ID NO: 33954 - RNA, 1701 nt, Artificial Sequence
  hemagglutinin__InfluenzaA__ACX31961
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucauggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33955 - RNA, 1701 nt, Artificial Sequence
  hemagglutinin__InfluenzaA__ACX31962
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33956 - RNA, 1701 nt, Artificial Sequence
  hemagglutinin__InfluenzaA__ACX31964
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaucacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33957 - RNA, 1701 nt, Artificial Sequence; identical to SEQ ID NO: 33168
  hemagglutinin__InfluenzaA__ACX35237

SEQ ID NO: 33958 - RNA, 1701 nt, Artificial Sequence; identical to SEQ ID NO: 33173
  hemagglutinin__InfluenzaA__ACX35247

SEQ ID NO: 33959 - RNA, 1701 nt, Artificial Sequence; identical to SEQ ID NO: 33173
  hemagglutinin__InfluenzaA__ACX35257

SEQ ID NO: 33960 - RNA, 1701 nt, Artificial Sequence; identical to SEQ ID NO: 33173
  hemagglutinin__InfluenzaA__ACX35267

SEQ ID NO: 33961 - RNA, 1701 nt, Artificial Sequence; identical to SEQ ID NO: 33173
  hemagglutinin__InfluenzaA__ACX35277

SEQ ID NO: 33962 - RNA, 1701 nt, Artificial Sequence; identical to SEQ ID NO: 33173
  hemagglutinin__InfluenzaA__ACX35287

SEQ ID NO: 33963 - RNA, 1701 nt, Artificial Sequence; identical to SEQ ID NO: 33387
  hemagglutinin__InfluenzaA__ACX35297

SEQ ID NO: 33964 - RNA, 1701 nt, Artificial Sequence
  hemagglutinin__InfluenzaA__ACX35307
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagggccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33965 - RNA, 1701 nt, Artificial Sequence; identical to SEQ ID NO: 33457
  hemagglutinin__InfluenzaA__ACX35317

SEQ ID NO: 33966 - RNA, 1701 nt, Artificial Sequence
  hemagglutinin__InfluenzaA__ACX35327
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33967 - RNA, 1701 nt, Artificial Sequence
  hemagglutinin__InfluenzaA__ACX36501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33968 - RNA, 1701 nt, Artificial Sequence
  hemagglutinin__InfluenzaA__ACX36502
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33969 - RNA, 1701 nt, Artificial Sequence
  hemagglutinin__InfluenzaA__ACX36503
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaauaccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33970 - RNA, 1701 nt, Artificial Sequence
  hemagglutinin__InfluenzaA__ACX47367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33971 - RNA, 1701 nt, Artificial Sequence
  hemagglutinin__InfluenzaA__ACX47368
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33972 - RNA, 1701 nt, Artificial Sequence; identical to SEQ ID NO: 33971
  hemagglutinin__InfluenzaA__ACX47369

SEQ ID NO: 33973 - RNA, 1701 nt, Artificial Sequence
  hemagglutinin__InfluenzaA__ACX47370
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccgacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33974 - RNA, 1701 nt, Artificial Sequence; identical to SEQ ID NO: 33971
  hemagglutinin__InfluenzaA__ACX47371

SEQ ID NO: 33975 - RNA, 1701 nt, Artificial Sequence; identical to SEQ ID NO: 33971
  hemagglutinin__InfluenzaA__ACX47372

SEQ ID NO: 33976 - RNA, 1701 nt, Artificial Sequence; identical to SEQ ID NO: 33971
  hemagglutinin__InfluenzaA__ACX47373

SEQ ID NO: 33977 - RNA, 1701 nt, Artificial Sequence; identical to SEQ ID NO: 33971
  hemagglutinin__InfluenzaA__ACX47374

SEQ ID NO: 33978 - RNA, 1701 nt, Artificial Sequence
  hemagglutinin__InfluenzaA__ACX47375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaacggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33979 - RNA, 1701 nt, Artificial Sequence; identical to SEQ ID NO: 33971
  hemagglutinin__InfluenzaA__ACX47376

SEQ ID NO: 33980 - RNA, 1701 nt, Artificial Sequence; identical to SEQ ID NO: 33971
  hemagglutinin__InfluenzaA__ACX47377

SEQ ID NO: 33981 - RNA, 1701 nt, Artificial Sequence
  hemagglutinin__InfluenzaA__ACX47380
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucguaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33982 - RNA, 1701 nt, Artificial Sequence; identical to SEQ ID NO: 33981
  hemagglutinin__InfluenzaA__ACX47381

SEQ ID NO: 33983 - RNA, 1701 nt, Artificial Sequence; identical to SEQ ID NO: 33981
  hemagglutinin__InfluenzaA__ACX47382

SEQ ID NO: 33984 - RNA, 1701 nt, Artificial Sequence
  hemagglutinin__InfluenzaA__ACX47383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33985 - RNA, 1701 nt, Artificial Sequence
  hemagglutinin__InfluenzaA__ACX47384
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33986 - RNA, 1701 nt, Artificial Sequence; identical to SEQ ID NO: 33985
  hemagglutinin__InfluenzaA__ACX47385

SEQ ID NO: 33987 - RNA, 1701 nt, Artificial Sequence; identical to SEQ ID NO: 33985
  hemagglutinin__InfluenzaA__ACX47387

SEQ ID NO: 33988 - RNA, 1701 nt, Artificial Sequence
  hemagglutinin__InfluenzaA__ACX55834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaaucacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33989 - RNA, 1701 nt, Artificial Sequence
  hemagglutinin__InfluenzaA__ACX61574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33990 - RNA, 1701 nt, Artificial Sequence
  hemagglutinin__InfluenzaA__ACX61575
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 33991 - RNA, 1701 nt, Artificial Sequence
  hemagglutinin__InfluenzaA__ACX83577
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33992 - RNA, 1701 nt, Artificial Sequence
  hemagglutinin__InfluenzaA__ACX94091
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaauuucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguucaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33993 - RNA, 1701 nt, Artificial Sequence
  hemagglutinin__InfluenzaA__ACY26192
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaggaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33994 - RNA, 1701 nt, Artificial Sequence
  hemagglutinin__InfluenzaA__ACY26202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33995 - RNA, 1701 nt, Artificial Sequence; identical to SEQ ID NO: 33173
  hemagglutinin__InfluenzaA__ACY46103

SEQ ID NO: 33996 - RNA, 1701 nt, Artificial Sequence; identical to SEQ ID NO: 33206
  hemagglutinin__InfluenzaA__ACY46113

SEQ ID NO: 33997 - RNA, 1701 nt, Artificial Sequence
  hemagglutinin__InfluenzaA__ACY46123
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugggggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 33998 - RNA, 1701 nt, Artificial Sequence; identical to SEQ ID NO: 33173
  hemagglutinin__InfluenzaA__ACY46133

SEQ ID NO: 33999 - RNA, 1701 nt, Artificial Sequence; identical to SEQ ID NO: 33173
  hemagglutinin__InfluenzaA__ACY46163

SEQ ID NO: 34000 - RNA, 1701 nt, Artificial Sequence
  hemagglutinin__InfluenzaA__ACY46173
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaacugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34001 - RNA, 1701 nt, Artificial Sequence
  hemagglutinin__InfluenzaA__ACY46213
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagacacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34002 - RNA, 1701 nt, Artificial Sequence; identical to SEQ ID NO: 34001
  hemagglutinin__InfluenzaA__ACY46223

SEQ ID NO: 34003 - RNA, 1701 nt, Artificial Sequence; identical to SEQ ID NO: 33173
  hemagglutinin__InfluenzaA__ACY46233

SEQ ID NO: 34004 - RNA, 1701 nt, Artificial Sequence; identical to SEQ ID NO: 33173
  hemagglutinin__InfluenzaA__ACY46243

SEQ ID NO: 34005 - RNA, 1701 nt, Artificial Sequence; identical to SEQ ID NO: 33173
  hemagglutinin__InfluenzaA__ACY46253

SEQ ID NO: 34006 - RNA, 1701 nt, Artificial Sequence; identical to SEQ ID NO: 33173
  hemagglutinin__InfluenzaA__ACY46263

SEQ ID NO: 34007 - RNA, 1701 nt, Artificial Sequence; identical to SEQ ID NO: 33173
  hemagglutinin__InfluenzaA__ACY46273

SEQ ID NO: 34008 - RNA, 1701 nt, Artificial Sequence; identical to SEQ ID NO: 33173
  hemagglutinin__InfluenzaA__ACY46283

SEQ ID NO: 34009 - RNA, 1701 nt, Artificial Sequence
  hemagglutinin__InfluenzaA__ACY46293
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccgcaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34010 - RNA, 1701 nt, Artificial Sequence; identical to SEQ ID NO: 33173
  hemagglutinin__InfluenzaA__ACY46303

SEQ ID NO: 34011 - RNA, 1701 nt, Artificial Sequence; identical to SEQ ID NO: 33173
  hemagglutinin__InfluenzaA__ACY46313

SEQ ID NO: 34012 - RNA, 1701 nt, Artificial Sequence; identical to SEQ ID NO: 33173
  hemagglutinin__InfluenzaA__ACY46323

SEQ ID NO: 34013 - RNA, 1701 nt, Artificial Sequence
  hemagglutinin__InfluenzaA__ACY46343
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34014 - RNA, 1701 nt, Artificial Sequence; identical to SEQ ID NO: 33173
  hemagglutinin__InfluenzaA__ACY46353

SEQ ID NO: 34015 - RNA, 1701 nt, Artificial Sequence
  hemagglutinin__InfluenzaA__ACY46373
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuuuauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34016 - RNA, 1701 nt, Artificial Sequence
  hemagglutinin__InfluenzaA__ACY46383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucuuggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34017 - RNA, 1701 nt, Artificial Sequence; identical to SEQ ID NO: 33173
  hemagglutinin__InfluenzaA__ACY46393

SEQ ID NO: 34018 - RNA, 1701 nt, Artificial Sequence; identical to SEQ ID NO: 33173
  hemagglutinin__InfluenzaA__ACY46403

SEQ ID NO: 34019 - RNA, 1701 nt, Artificial Sequence; identical to SEQ ID NO: 33173
  hemagglutinin__InfluenzaA__ACY46413

SEQ ID NO: 34020 - RNA, 1701 nt, Artificial Sequence; identical to SEQ ID NO: 34001
  hemagglutinin__InfluenzaA__ACY46433

SEQ ID NO: 34021 - RNA, 1701 nt, Artificial Sequence; identical to SEQ ID NO: 34001
  hemagglutinin__InfluenzaA__ACY46443

SEQ ID NO: 34022 - RNA, 1701 nt, Artificial Sequence; identical to SEQ ID NO: 33173
  hemagglutinin__InfluenzaA__ACY46453

SEQ ID NO: 34023 - RNA, 1701 nt, Artificial Sequence
  hemagglutinin__InfluenzaA__ACY46463
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34024 - RNA, 1701 nt, Artificial Sequence; identical to SEQ ID NO: 33173
  hemagglutinin__InfluenzaA__ACY46473

SEQ ID NO: 34025 - RNA, 1701 nt, Artificial Sequence; identical to SEQ ID NO: 33197
  hemagglutinin__InfluenzaA__ACY46493

SEQ ID NO: 34026 - RNA, 1701 nt, Artificial Sequence
  hemagglutinin__InfluenzaA__ACY46513
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggugauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggauaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34027 - RNA, 1701 nt, Artificial Sequence; identical to SEQ ID NO: 33173
  hemagglutinin__InfluenzaA__ACY46523

SEQ ID NO: 34028 - RNA, 1701 nt, Artificial Sequence; identical to SEQ ID NO: 33173
  hemagglutinin__InfluenzaA__ACY46533

SEQ ID NO: 34029 - RNA, 1701 nt, Artificial Sequence; identical to SEQ ID NO: 33173
  hemagglutinin__InfluenzaA__ACY46562

SEQ ID NO: 34030 - RNA, 1701 nt, Artificial Sequence; identical to SEQ ID NO: 33173
  hemagglutinin__InfluenzaA__ACY46572

SEQ ID NO: 34031 - RNA, 1701 nt, Artificial Sequence; identical to SEQ ID NO: 33173
  hemagglutinin__InfluenzaA__ACY46582

SEQ ID NO: 34032 - RNA, 1701 nt, Artificial Sequence; identical to SEQ ID NO: 33173
  hemagglutinin__InfluenzaA__ACY46592

SEQ ID NO: 34033 - RNA, 1701 nt, Artificial Sequence; identical to SEQ ID NO: 34001
  hemagglutinin__InfluenzaA__ACY46622

SEQ ID NO: 34034 - RNA, 1701 nt, Artificial Sequence
  hemagglutinin__InfluenzaA__ACY46672
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugguaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34035 - RNA, 1701 nt, Artificial Sequence; identical to SEQ ID NO: 33173
  hemagglutinin__InfluenzaA__ACY46682

SEQ ID NO: 34036 - RNA, 1701 nt, Artificial Sequence; identical to SEQ ID NO: 33173
  hemagglutinin__InfluenzaA__ACY46692

SEQ ID NO: 34037 - RNA, 1701 nt, Artificial Sequence; identical to SEQ ID NO: 33173
  hemagglutinin__InfluenzaA__ACY46712

SEQ ID NO: 34038 - RNA, 1701 nt, Artificial Sequence
  hemagglutinin__InfluenzaA__ACY46722
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuaugggguauucaccauccaucuacuagugcuggccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34039 - RNA, 1701 nt, Artificial Sequence
  hemagglutinin__InfluenzaA__ACY46742
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34040 - RNA, 1701 nt, Artificial Sequence; identical to SEQ ID NO: 33173
  hemagglutinin__InfluenzaA__ACY46762

SEQ ID NO: 34041 - RNA, 1701 nt, Artificial Sequence
  hemagglutinin__InfluenzaA__ACY46772
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuaugggguauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34042 - RNA, 1701 nt, Artificial Sequence
  hemagglutinin__InfluenzaA__ACY46903
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucggacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34043 - RNA, 1701 nt, Artificial Sequence
  hemagglutinin__InfluenzaA__ACY77534
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucauuacaguguagaauauguauuuaa

SEQ ID NO: 34044 - RNA, 1698 nt, Artificial Sequence
  hemagglutinin__InfluenzaA__ACY77544
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34045 - RNA, 1698 nt, Artificial Sequence
  hemagglutinin__InfluenzaA__ACY77554
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacaguaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucaucuacaguguagaauauguauuuaa

SEQ ID NO: 34046 - RNA, 1695 nt, Artificial Sequence
  hemagglutinin__InfluenzaA__ACY77573
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagagugccauugacgagauuacuaacaaaguaaauucuguuauugaaaagaugaauacacaguugacaggccaguguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaugaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 34047 - RNA, 1701 nt, Artificial Sequence
  hemagglutinin__InfluenzaA__ACY77593
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34048 - RNA, 1698 nt, Artificial Sequence
  hemagglutinin__InfluenzaA__ACY77603
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34049 - RNA, 1695 nt, Artificial Sequence
  hemagglutinin__InfluenzaA__ACY77613
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 34050 - RNA, 1701 nt, Artificial Sequence
  hemagglutinin__InfluenzaA__ACY77623
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34051 - RNA, 1707 nt, Artificial Sequence
  hemagglutinin__InfluenzaA__ACY77653
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagugggucucuacaguguagaauauguauuuaa

SEQ ID NO: 34052 - RNA, 1698 nt, Artificial Sequence
  hemagglutinin__InfluenzaA__ACY77663
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacuguguagaauauguauuuaa

SEQ ID NO: 34053 - RNA, 1698 nt, Artificial Sequence
  hemagglutinin__InfluenzaA__ACY77683
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34054 - RNA, 1698 nt, Artificial Sequence
  hemagglutinin__InfluenzaA__ACY77693
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauaacaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34055 - RNA, 1698 nt, Artificial Sequence
  hemagglutinin__InfluenzaA__ACY77703
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34056 - RNA, 1698 nt, Artificial Sequence
  hemagglutinin__InfluenzaA__ACY77713
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucaucuacaguguagaauauguauuuaa

SEQ ID NO: 34057 - RNA, 1701 nt, Artificial Sequence; identical to SEQ ID NO: 33486
  hemagglutinin__InfluenzaA__ACY77723

SEQ ID NO: 34058 - RNA, 1695 nt, Artificial Sequence
  hemagglutinin__InfluenzaA__ACY77733
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaacaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucuacaguguagaauauguauuuaa

SEQ ID NO: 34059 - RNA, 1698 nt, Artificial Sequence
  hemagglutinin__InfluenzaA__ACY77743
augaaggcuauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaagcucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34060 - RNA, 1701 nt, Artificial Sequence; identical to SEQ ID NO: 33173
  hemagglutinin__InfluenzaA__ACY77753

SEQ ID NO: 34061 - RNA, 1695 nt, Artificial Sequence
  hemagglutinin__InfluenzaA__ACY77783
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuaggagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucggacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagagcuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucauagcuguagaauauguauuuaa

SEQ ID NO: 34062 - RNA, 1698 nt, Artificial Sequence
  hemagglutinin__InfluenzaA__ACY77813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucaucuacaguguagaauauguauuuaa

SEQ ID NO: 34063 - RNA, 1698 nt, Artificial Sequence
  hemagglutinin__InfluenzaA__ACY77823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacaggccaguguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34064 - RNA, 1698 nt, Artificial Sequence
  hemagglutinin__InfluenzaA__ACY77833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuuggucucuacaguguagaauauguauuuaa

SEQ ID NO: 34065 - RNA, 1698 nt, Artificial Sequence
  hemagglutinin__InfluenzaA__ACY77843
augaaggcaauacuaguaguuaugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaacaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggucaucuacaguguagaauauguauuuaa

SEQ ID NO: 34066 - RNA, 1701 nt, Artificial Sequence
  hemagglutinin__InfluenzaA__ACY77863
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuggaaugucucuacaguguagaauauguauuuaa

SEQ ID NO: 34067 - RNA, 1701 nt, Artificial Sequence; identical to SEQ ID NO: 33197
  hemagglutinin__InfluenzaA__ACY77874

SEQ ID NO: 34068 - RNA, 1701 nt, Artificial Sequence
  hemagglutinin__InfluenzaA__ACY77884
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34069 - RNA, 1701 nt, Artificial Sequence
  hemagglutinin__InfluenzaA__ACY77904
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaacauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34070 - RNA, 1701 nt, Artificial Sequence; identical to SEQ ID NO: 33390
  hemagglutinin__InfluenzaA__ACY77914

SEQ ID NO: 34071 - RNA, 1701 nt, Artificial Sequence
  hemagglutinin__InfluenzaA__ACY77924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34072 - RNA, 1701 nt, Artificial Sequence
  hemagglutinin__InfluenzaA__ACY77934
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuaggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34073 - RNA, 1701 nt, Artificial Sequence
  hemagglutinin__InfluenzaA__ACY77944
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34074 - RNA, 1701 nt, Artificial Sequence; identical to SEQ ID NO: 33197
  hemagglutinin__InfluenzaA__ACY77954

SEQ ID NO: 34075 - RNA, 1701 nt, Artificial Sequence
  hemagglutinin__InfluenzaA__ACY77964
augaaggcaauacuaguaguucugcuauauacauuugcaaccgcaaaugcagacacauuauguauagguuaucaugcgaacaauucaacagacacuguagacacaguacuagaaaaaaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34076 - RNA, 1701 nt, Artificial Sequence; identical to SEQ ID NO: 33168
  hemagglutinin__InfluenzaA__ACY77974

SEQ ID NO: 34077 - RNA, 1701 nt, Artificial Sequence
  hemagglutinin__InfluenzaA__ACY77984
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34078 - RNA, 1701 nt, Artificial Sequence; identical to SEQ ID NO: 33197
  hemagglutinin__InfluenzaA__ACY77994

SEQ ID NO: 34079 - RNA, 1701 nt, Artificial Sequence
  hemagglutinin__InfluenzaA__ACY79633
augaaggaaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcuuucgcaauggaaagaaaugcucgaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34080 - RNA, 1701 nt, Artificial Sequence
  hemagglutinin__InfluenzaA__ACZ01953
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccaaauuuuggcgaucuauucaacugucgccaguucauugguacugguagucucccugggggcaaucaguuucuggaugugcucuaaugggucucuacaguguagaauauguauuuaa

SEQ ID NO: 34081 - RNA, 1701 nt, Artificial Sequence
  hemagglutinin__InfluenzaA__ACZ05050
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34082 - RNA, 1701 nt, Artificial Sequence
  hemagglutinin__InfluenzaA__ACZ05061
auggaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34083 - RNA, 1701 nt, Artificial Sequence; identical to SEQ ID NO: 33197
  hemagglutinin__InfluenzaA__ACZ05071

SEQ ID NO: 34084 - RNA, 1701 nt, Artificial Sequence; identical to SEQ ID NO: 33197
  hemagglutinin__InfluenzaA__ACZ05081

SEQ ID NO: 34085 - RNA, 1701 nt, Artificial Sequence; identical to SEQ ID NO: 33197
  hemagglutinin__InfluenzaA__ACZ05091

SEQ ID NO: 34086 - RNA, 1701 nt, Artificial Sequence; identical to SEQ ID NO: 33197
  hemagglutinin__InfluenzaA__ACZ05101

SEQ ID NO: 34087 - RNA, 1701 nt, Artificial Sequence; identical to SEQ ID NO: 33197
  hemagglutinin__InfluenzaA__ACZ05111

SEQ ID NO: 34088 - RNA, 1701 nt, Artificial Sequence
  hemagglutinin__InfluenzaA__ACZ05121
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaacaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcaugggaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34089 - RNA, 1701 nt, Artificial Sequence; identical to SEQ ID NO: 33197
  hemagglutinin__InfluenzaA__ACZ05131

SEQ ID NO: 34090 - RNA, 1701 nt, Artificial Sequence; identical to SEQ ID NO: 33197
  hemagglutinin__InfluenzaA__ACZ05141

SEQ ID NO: 34091 - RNA, 1701 nt, Artificial Sequence; identical to SEQ ID NO: 33197
  hemagglutinin__InfluenzaA__ACZ05151

SEQ ID NO: 34092 - RNA, 1701 nt, Artificial Sequence
  hemagglutinin__InfluenzaA__ACZ05172
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaauggaaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34093 - RNA, 1698 nt, Artificial Sequence
  hemagglutinin__InfluenzaA__ACZ05194
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaagugagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34094 - RNA, 1701 nt, Artificial Sequence
  hemagglutinin__InfluenzaA__ACZ05205
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34095 - RNA, 1701 nt, Artificial Sequence
  hemagglutinin__InfluenzaA__ACZ05216
augaagacuaucauugcuuugagcuacauucuaugucugguuuucgcucaaaaaauuccuggaaaugacaacaacacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccauuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucaaauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaaaggaguugagcuuaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34096 - RNA, 1701 nt, Artificial Sequence; identical to SEQ ID NO: 34092
  hemagglutinin__InfluenzaA__ACZ05227

SEQ ID NO: 34097 - RNA, 1701 nt, Artificial Sequence
  hemagglutinin__InfluenzaA__ACZ05238
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34098 - RNA, 1701 nt, Artificial Sequence; identical to SEQ ID NO: 34094
  hemagglutinin__InfluenzaA__ACZ05249

SEQ ID NO: 34099 - RNA, 1701 nt, Artificial Sequence; identical to SEQ ID NO: 34094
  hemagglutinin__InfluenzaA__ACZ05260

SEQ ID NO: 34100 - RNA, 1701 nt, Artificial Sequence
  hemagglutinin__InfluenzaA__ACZ05271
augaagacuaucauugcuuugagcuacauucuaugucugguuuucgcucaaaaacuuccuggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacaguuucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagagacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34101 - RNA, 1701 nt, Artificial Sequence
  hemagglutinin__InfluenzaA__ACZ05282
augaagacuaccauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauuaggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucaccccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucggaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34102 - RNA, 1701 nt, Artificial Sequence; identical to SEQ ID NO: 34094
  hemagglutinin__InfluenzaA__ACZ05304

SEQ ID NO: 34103 - RNA, 1701 nt, Artificial Sequence
  hemagglutinin__InfluenzaA__ACZ05315
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34104 - RNA, 1701 nt, Artificial Sequence; identical to SEQ ID NO: 34092
  hemagglutinin__InfluenzaA__ACZ05326

SEQ ID NO: 34105 - RNA, 1701 nt, Artificial Sequence
  hemagglutinin__InfluenzaA__ACZ05337
augaagacuaucauugcuuugagcuacauucuaugucugguuuucacucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagauucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuagcagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugaaggaagaggacaagcagcagaucucaaaagcacucaagcagcaaucgaucaaaucaacgggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaucacgauguauacagagaugaagcauuaaacaaccgguuucagaucaagggaguugagcugaagucaggguucaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34106 - RNA, 1701 nt, Artificial Sequence; identical to SEQ ID NO: 34094
  hemagglutinin__InfluenzaA__ACZ05348

SEQ ID NO: 34107 - RNA, 1701 nt, Artificial Sequence; identical to SEQ ID NO: 34097
  hemagglutinin__InfluenzaA__ACZ05359

SEQ ID NO: 34108 - RNA, 1701 nt, Artificial Sequence; identical to SEQ ID NO: 34092
  hemagglutinin__InfluenzaA__ACZ05370

SEQ ID NO: 34109 - RNA, 1701 nt, Artificial Sequence
  hemagglutinin__InfluenzaA__ACZ05392
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggagcaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34110 - RNA, 1701 nt, Artificial Sequence; identical to SEQ ID NO: 34092
  hemagglutinin__InfluenzaA__ACZ05403

SEQ ID NO: 34111 - RNA, 1701 nt, Artificial Sequence
  hemagglutinin__InfluenzaA__ACZ05436
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaagcugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuacgaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34112 - RNA, 1701 nt, Artificial Sequence; identical to SEQ ID NO: 34092
  hemagglutinin__InfluenzaA__ACZ05458

SEQ ID NO: 34113 - RNA, 1701 nt, Artificial Sequence; identical to SEQ ID NO: 34092
  hemagglutinin__InfluenzaA__ACZ05469

SEQ ID NO: 34114 - RNA, 1701 nt, Artificial Sequence; identical to SEQ ID NO: 34111
  hemagglutinin__InfluenzaA__ACZ05480

SEQ ID NO: 34115 - RNA, 1701 nt, Artificial Sequence; identical to SEQ ID NO: 34103
  hemagglutinin__InfluenzaA__ACZ05513

SEQ ID NO: 34116 - RNA, 1701 nt, Artificial Sequence; identical to SEQ ID NO: 34094
  hemagglutinin__InfluenzaA__ACZ05524

SEQ ID NO: 34117 - RNA, 1701 nt, Artificial Sequence
  hemagglutinin__InfluenzaA__ACZ05535
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34118 - RNA, 1701 nt, Artificial Sequence
  hemagglutinin__InfluenzaA__ACZ05546
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacgaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34119 - RNA, 1701 nt, Artificial Sequence; identical to SEQ ID NO: 34092
  hemagglutinin__InfluenzaA__ACZ05557

SEQ ID NO: 34120 - RNA, 1698 nt, Artificial Sequence
  hemagglutinin__InfluenzaA__ACZ05579
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaaugggaaacuauguuuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggugaagaauggcuuguacccaaacuugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucggggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaaccuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34121 - RNA, 1698 nt, Artificial Sequence
  hemagglutinin__InfluenzaA__ACZ05590
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaagugaccaaaagacccucuaucauacagaagaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacuccucagggagcuauaaacagcagucuuccuuuucagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34122 - RNA, 1701 nt, Artificial Sequence; identical to SEQ ID NO: 34117
  hemagglutinin__InfluenzaA__ACZ05950

SEQ ID NO: 34123 - RNA, 1701 nt, Artificial Sequence; identical to SEQ ID NO: 34094
  hemagglutinin__InfluenzaA__ACZ05961

SEQ ID NO: 34124 - RNA, 1701 nt, Artificial Sequence
  hemagglutinin__InfluenzaA__ACZ05972
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguucuuugcuuuguguugcuuuguugggguucaucaugugggccugccaaaaaggcaacauuaggugcaacauuugcauuuga

SEQ ID NO: 34125 - RNA, 1701 nt, Artificial Sequence
  hemagglutinin__InfluenzaA__ACZ05983
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaacacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34126 - RNA, 1701 nt, Artificial Sequence
  hemagglutinin__InfluenzaA__ACZ05994
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacugugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34127 - RNA, 1701 nt, Artificial Sequence; identical to SEQ ID NO: 34094
  hemagglutinin__InfluenzaA__ACZ06005

SEQ ID NO: 34128 - RNA, 1701 nt, Artificial Sequence; identical to SEQ ID NO: 34094
  hemagglutinin__InfluenzaA__ACZ06016

SEQ ID NO: 34129 - RNA, 1698 nt, Artificial Sequence
  hemagglutinin__InfluenzaA__ACZ16013
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuauguuuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaagcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaaaugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaguaggcaaagaauucaacaaauuggaaagaaggauggaaaacuugaauaagaaaguugaugauggguuuauagacauuuggacauauaaugcagaacuguugguucuacuggaaaaugaaaggacuuuggauuuccaugacuccaaugugaagaaucuguaugagaaaguaaaaagccaguugaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34130 - RNA, 1698 nt, Artificial Sequence
  hemagglutinin__InfluenzaA__ACZ16023
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaacuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaguaggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaguucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34131 - RNA, 1698 nt, Artificial Sequence
  hemagglutinin__InfluenzaA__ACZ16033
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaggaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacauacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacaaggagaaaauugauggagugaaauuggaaucaaugggagucuaucagauucuggcgaucuacucaacagucgcaaguucucugguucuuuuggucucccugggggcaaucagcuucuggauguguuccaaugggucuuugcaguguagaauaugcaucuaa

SEQ ID NO: 34132 - RNA, 1701 nt, Artificial Sequence; identical to SEQ ID NO: 33197
  hemagglutinin__InfluenzaA__ACZ16040

SEQ ID NO: 34133 - RNA, 1701 nt, Artificial Sequence
  hemagglutinin__InfluenzaA__ACZ16050
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34134 - RNA, 1701 nt, Artificial Sequence; identical to SEQ ID NO: 33197
  hemagglutinin__InfluenzaA__ACZ16060

SEQ ID NO: 34135 - RNA, 1701 nt, Artificial Sequence
  hemagglutinin__InfluenzaA__ACZ16070
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuagccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacguucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34136 - RNA, 1701 nt, Artificial Sequence
  hemagglutinin__InfluenzaA__ACZ16080
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugauggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34137 - RNA, 1701 nt, Artificial Sequence
  hemagglutinin__InfluenzaA__ACZ16090
augaaggcaauacuauuaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaaugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34138 - RNA, 1701 nt, Artificial Sequence; identical to SEQ ID NO: 33197
  hemagglutinin__InfluenzaA__ACZ16100

SEQ ID NO: 34139 - RNA, 1701 nt, Artificial Sequence
  hemagglutinin__InfluenzaA__ACZ16110
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34140 - RNA, 1701 nt, Artificial Sequence
  hemagglutinin__InfluenzaA__ACZ16120
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34141 - RNA, 1701 nt, Artificial Sequence; identical to SEQ ID NO: 33912
  hemagglutinin__InfluenzaA__ACZ16130

SEQ ID NO: 34142 - RNA, 1701 nt, Artificial Sequence; identical to SEQ ID NO: 33197
  hemagglutinin__InfluenzaA__ACZ16140

SEQ ID NO: 34143 - RNA, 1701 nt, Artificial Sequence
  hemagglutinin__InfluenzaA__ACZ16150
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaaucuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34144 - RNA, 1701 nt, Artificial Sequence; identical to SEQ ID NO: 33197
  hemagglutinin__InfluenzaA__ACZ16160

SEQ ID NO: 34145 - RNA, 1701 nt, Artificial Sequence
  hemagglutinin__InfluenzaA__ACZ16170
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34146 - RNA, 1701 nt, Artificial Sequence
  hemagglutinin__InfluenzaA__ACZ16180
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuacacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 34147 - RNA, 1701 nt, Artificial Sequence; identical to SEQ ID NO: 34068
  hemagglutinin__InfluenzaA__ACZ16190

SEQ ID NO: 34148 - RNA, 1701 nt, Artificial Sequence
  hemagglutinin__InfluenzaA__ACZ16200
augaaggcaauacuaguaguucugcuauauacauuugcaaccgcaaauccagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34149 - RNA, 1701 nt, Artificial Sequence
  hemagglutinin__InfluenzaA__ACZ16210
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34150 - RNA, 1701 nt, Artificial Sequence; identical to SEQ ID NO: 33197
  hemagglutinin__InfluenzaA__ACZ16220

SEQ ID NO: 34151 - RNA, 1701 nt, Artificial Sequence
  hemagglutinin__InfluenzaA__ACZ16230
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaaggcccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccgguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34152 - RNA, 1701 nt, Artificial Sequence
  hemagglutinin__InfluenzaA__ACZ16240
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcccuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34153 - RNA, 1701 nt, Artificial Sequence
  hemagglutinin__InfluenzaA__ACZ16260
augaaagcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34154 - RNA, 1701 nt, Artificial Sequence
  hemagglutinin__InfluenzaA__ACZ16270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaaucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuucuggaugugcucuaaugggucucuacaguguagaauauguauuuaa

SEQ ID NO: 34155 - RNA, 1701 nt, Artificial Sequence; identical to SEQ ID NO: 33849
  hemagglutinin__InfluenzaA__ACZ16280

SEQ ID NO: 34156 - RNA, 1701 nt, Artificial Sequence
  hemagglutinin__InfluenzaA__ACZ16290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34157 - RNA, 1701 nt, Artificial Sequence
  hemagglutinin__InfluenzaA__ACZ16300
augaaggcaauacuaguaguucugcuauauacauuugcaaccgcaaaugcagacacauuauguauagguuaucaugcgaacaauucaacagacacuguagacacaguacuagaaaagaauguaauaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34158 - RNA, 1701 nt, Artificial Sequence; identical to SEQ ID NO: 33903
  hemagglutinin__InfluenzaA__ACZ16310

SEQ ID NO: 34159 - RNA, 1701 nt, Artificial Sequence
  hemagglutinin__InfluenzaA__ACZ16320
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaagauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34160 - RNA, 1701 nt, Artificial Sequence; identical to SEQ ID NO: 33903
  hemagglutinin__InfluenzaA__ACZ16330

SEQ ID NO: 34161 - RNA, 1701 nt, Artificial Sequence
  hemagglutinin__InfluenzaA__ACZ16340
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuuagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34162 - RNA, 1701 nt, Artificial Sequence; identical to SEQ ID NO: 33197
  hemagglutinin__InfluenzaA__ACZ16350

SEQ ID NO: 34163 - RNA, 1701 nt, Artificial Sequence; identical to SEQ ID NO: 33839
  hemagglutinin__InfluenzaA__ACZ16360

SEQ ID NO: 34164 - RNA, 1701 nt, Artificial Sequence; identical to SEQ ID NO: 34145
  hemagglutinin__InfluenzaA__ACZ16370

SEQ ID NO: 34165 - RNA, 1701 nt, Artificial Sequence; identical to SEQ ID NO: 34143
  hemagglutinin__InfluenzaA__ACZ16380

SEQ ID NO: 34166 - RNA, 1701 nt, Artificial Sequence
  hemagglutinin__InfluenzaA__ACZ16390
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34167 - RNA, 1701 nt, Artificial Sequence; identical to SEQ ID NO: 33197
  hemagglutinin__InfluenzaA__ACZ16400

SEQ ID NO: 34168 - RNA, 1701 nt, Artificial Sequence; identical to SEQ ID NO: 33197
  hemagglutinin__InfluenzaA__ACZ16410

SEQ ID NO: 34169 - RNA, 1701 nt, Artificial Sequence; identical to SEQ ID NO: 33797
  hemagglutinin__InfluenzaA__ACZ16420

SEQ ID NO: 34170 - RNA, 1701 nt, Artificial Sequence; identical to SEQ ID NO: 33197
  hemagglutinin__InfluenzaA__ACZ16430

SEQ ID NO: 34171 - RNA, 1701 nt, Artificial Sequence
  hemagglutinin__InfluenzaA__ACZ16440
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaagagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34172 - RNA, 1701 nt, Artificial Sequence
  hemagglutinin__InfluenzaA__ACZ16450
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34173 - RNA, 1701 nt, Artificial Sequence
  hemagglutinin__InfluenzaA__ACZ16460
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34174 - RNA, 1701 nt, Artificial Sequence
  hemagglutinin__InfluenzaA__ACZ16470
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaaaaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34175 - RNA, 1701 nt, Artificial Sequence; identical to SEQ ID NO: 33197
  hemagglutinin__InfluenzaA__ACZ16480

SEQ ID NO: 34176 - RNA, 1701 nt, Artificial Sequence
  hemagglutinin__InfluenzaA__ACZ16490
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuaccagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34177 - RNA, 1701 nt, Artificial Sequence; identical to SEQ ID NO: 33197
  hemagglutinin__InfluenzaA__ACZ16500

SEQ ID NO: 34178 - RNA, 1701 nt, Artificial Sequence; identical to SEQ ID NO: 34161
  hemagglutinin__InfluenzaA__ACZ16510

SEQ ID NO: 34179 - RNA, 1701 nt, Artificial Sequence
  hemagglutinin__InfluenzaA__ACZ16530
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34180 - RNA, 1701 nt, Artificial Sequence
  hemagglutinin__InfluenzaA__ACZ16540
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuacuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34181 - RNA, 1701 nt, Artificial Sequence; identical to SEQ ID NO: 33903
  hemagglutinin__InfluenzaA__ACZ16550

SEQ ID NO: 34182 - RNA, 1701 nt, Artificial Sequence; identical to SEQ ID NO: 34068
  hemagglutinin__InfluenzaA__ACZ16583

SEQ ID NO: 34183 - RNA, 1701 nt, Artificial Sequence; identical to SEQ ID NO: 33903
  hemagglutinin__InfluenzaA__ACZ16593

SEQ ID NO: 34184 - RNA, 1701 nt, Artificial Sequence; identical to SEQ ID NO: 33197
  hemagglutinin__InfluenzaA__ACZ16603

SEQ ID NO: 34185 - RNA, 1701 nt, Artificial Sequence; identical to SEQ ID NO: 33903
  hemagglutinin__InfluenzaA__ACZ16630

SEQ ID NO: 34186 - RNA, 1701 nt, Artificial Sequence; identical to SEQ ID NO: 33869
  hemagglutinin__InfluenzaA__ACZ16640

SEQ ID NO: 34187 - RNA, 1701 nt, Artificial Sequence; identical to SEQ ID NO: 33197
  hemagglutinin__InfluenzaA__ACZ16650

SEQ ID NO: 34188 - RNA, 1701 nt, Artificial Sequence; identical to SEQ ID NO: 33197
  hemagglutinin__InfluenzaA__ACZ16660

SEQ ID NO: 34189 - RNA, 1701 nt, Artificial Sequence; identical to SEQ ID NO: 33197
  hemagglutinin__InfluenzaA__ACZ16670

SEQ ID NO: 34190 - RNA, 1701 nt, Artificial Sequence; identical to SEQ ID NO: 33197
  hemagglutinin__InfluenzaA__ACZ16680

SEQ ID NO: 34191 - RNA, 1701 nt, Artificial Sequence; identical to SEQ ID NO: 34153
  hemagglutinin__InfluenzaA__ACZ16690

SEQ ID NO: 34192 - RNA, 1701 nt, Artificial Sequence; identical to SEQ ID NO: 33197
  hemagglutinin__InfluenzaA__ACZ16700

SEQ ID NO: 34193 - RNA, 1701 nt, Artificial Sequence; identical to SEQ ID NO: 33197
  hemagglutinin__InfluenzaA__ACZ16710

SEQ ID NO: 34194 - RNA, 1701 nt, Artificial Sequence; identical to SEQ ID NO: 33197
  hemagglutinin__InfluenzaA__ACZ16720

SEQ ID NO: 34195 - RNA, 1701 nt, Artificial Sequence; identical to SEQ ID NO: 33903
  hemagglutinin__InfluenzaA__ACZ16730

SEQ ID NO: 34196 - RNA, 1701 nt, Artificial Sequence; identical to SEQ ID NO: 33903
  hemagglutinin__InfluenzaA__ACZ16740

SEQ ID NO: 34197 - RNA, 1701 nt, Artificial Sequence; identical to SEQ ID NO: 33197
  hemagglutinin__InfluenzaA__ACZ16750

SEQ ID NO: 34198 - RNA, 1701 nt, Artificial Sequence; identical to SEQ ID NO: 33197
  hemagglutinin__InfluenzaA__ACZ16760

SEQ ID NO: 34199 - RNA, 1701 nt, Artificial Sequence; identical to SEQ ID NO: 34145
  hemagglutinin__InfluenzaA__ACZ16770

SEQ ID NO: 34200 - RNA, 1701 nt, Artificial Sequence; identical to SEQ ID NO: 34171
  hemagglutinin__InfluenzaA__ACZ16780

SEQ ID NO: 34201 - RNA, 1701 nt, Artificial Sequence; identical to SEQ ID NO: 33197
  hemagglutinin__InfluenzaA__ACZ16790

SEQ ID NO: 34202 - RNA, 1701 nt, Artificial Sequence
  hemagglutinin__InfluenzaA__ACZ16800
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34203 - RNA, 1701 nt, Artificial Sequence; identical to SEQ ID NO: 33197
  hemagglutinin__InfluenzaA__ACZ16810

SEQ ID NO: 34204 - RNA, 1701 nt, Artificial Sequence
  hemagglutinin__InfluenzaA__ACZ16820
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggcuauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34205 - RNA, 1701 nt, Artificial Sequence; identical to SEQ ID NO: 33197
  hemagglutinin__InfluenzaA__ACZ16830

SEQ ID NO: 34206 - RNA, 1701 nt, Artificial Sequence
  hemagglutinin__InfluenzaA__ACZ16840
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagaaccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34207 - RNA, 1701 nt, Artificial Sequence; identical to SEQ ID NO: 33197
  hemagglutinin__InfluenzaA__ACZ16850

SEQ ID NO: 34208 - RNA, 1701 nt, Artificial Sequence
  hemagglutinin__InfluenzaA__ACZ16860
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34209 - RNA, 1701 nt, Artificial Sequence
  hemagglutinin__InfluenzaA__ACZ16870
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 34210 - RNA, 1701 nt, Artificial Sequence
  hemagglutinin__InfluenzaA__ACZ16880
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugauggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34211 - RNA, 1701 nt, Artificial Sequence
  hemagglutinin__InfluenzaA__ACZ16890
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34212 - RNA, 1701 nt, Artificial Sequence; identical to SEQ ID NO: 33197
  hemagglutinin__InfluenzaA__ACZ16900

SEQ ID NO: 34213 - RNA, 1701 nt, Artificial Sequence
  hemagglutinin__InfluenzaA__ACZ16910
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34214 - RNA, 1701 nt, Artificial Sequence; identical to SEQ ID NO: 33197
  hemagglutinin__InfluenzaA__ACZ16920

SEQ ID NO: 34215 - RNA, 1701 nt, Artificial Sequence; identical to SEQ ID NO: 33173
  hemagglutinin__InfluenzaA__ACZ16930

SEQ ID NO: 34216 - RNA, 1701 nt, Artificial Sequence; identical to SEQ ID NO: 33173
  hemagglutinin__InfluenzaA__ACZ16940

SEQ ID NO: 34217 - RNA, 1701 nt, Artificial Sequence; identical to SEQ ID NO: 33168
  hemagglutinin__InfluenzaA__ACZ16950

SEQ ID NO: 34218 - RNA, 1701 nt, Artificial Sequence
  hemagglutinin__InfluenzaA__ACZ16960
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcgguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34219 - RNA, 1701 nt, Artificial Sequence
  hemagglutinin__InfluenzaA__ACZ16970
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaagaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34220 - RNA, 1701 nt, Artificial Sequence
  hemagglutinin__InfluenzaA__ACZ16980
augaaggcaauacuaguaguucugcuauauacauuugcaaccgcaaaugcagacacauuauguauagguuaucaugcgaacaauucuacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaauguaaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34221 - RNA, 1701 nt, Artificial Sequence; identical to SEQ ID NO: 33173
  hemagglutinin__InfluenzaA__ACZ17000

SEQ ID NO: 34222 - RNA, 1701 nt, Artificial Sequence
  hemagglutinin__InfluenzaA__ACZ17010
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34223 - RNA, 1701 nt, Artificial Sequence
  hemagglutinin__InfluenzaA__ACZ17020
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34224 - RNA, 1701 nt, Artificial Sequence
  hemagglutinin__InfluenzaA__ACZ17030
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaagcaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34225 - RNA, 1701 nt, Artificial Sequence
  hemagglutinin__InfluenzaA__ACZ17040
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34226 - RNA, 1701 nt, Artificial Sequence
  hemagglutinin__InfluenzaA__ACZ17050
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguacacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34227 - RNA, 1701 nt, Artificial Sequence
  hemagglutinin__InfluenzaA__ACZ17060
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaagaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34228 - RNA, 1701 nt, Artificial Sequence; identical to SEQ ID NO: 33173
  hemagglutinin__InfluenzaA__ACZ17070

SEQ ID NO: 34229 - RNA, 1701 nt, Artificial Sequence; identical to SEQ ID NO: 33390
  hemagglutinin__InfluenzaA__ACZ17080

SEQ ID NO: 34230 - RNA, 1701 nt, Artificial Sequence
  hemagglutinin__InfluenzaA__ACZ17090
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuaggagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34231 - RNA, 1701 nt, Artificial Sequence; identical to SEQ ID NO: 33197
  hemagglutinin__InfluenzaA__ACZ17100

SEQ ID NO: 34232 - RNA, 1701 nt, Artificial Sequence
  hemagglutinin__InfluenzaA__ACZ17110
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccagagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34233 - RNA, 1701 nt, Artificial Sequence
  hemagglutinin__InfluenzaA__ACZ17120
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34234 - RNA, 1701 nt, Artificial Sequence
  hemagglutinin__InfluenzaA__ACZ17130
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaaugcacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34235 - RNA, 1701 nt, Artificial Sequence; identical to SEQ ID NO: 33971
  hemagglutinin__InfluenzaA__ACZ17140

SEQ ID NO: 34236 - RNA, 1701 nt, Artificial Sequence
  hemagglutinin__InfluenzaA__ACZ17150
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaccaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34237 - RNA, 1701 nt, Artificial Sequence; identical to SEQ ID NO: 34236
  hemagglutinin__InfluenzaA__ACZ17160

SEQ ID NO: 34238 - RNA, 1701 nt, Artificial Sequence; identical to SEQ ID NO: 34236
  hemagglutinin__InfluenzaA__ACZ17170

SEQ ID NO: 34239 - RNA, 1701 nt, Artificial Sequence
  hemagglutinin__InfluenzaA__ACZ17190
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaccaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaguacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34240 - RNA, 1701 nt, Artificial Sequence; identical to SEQ ID NO: 34239
  hemagglutinin__InfluenzaA__ACZ17200

SEQ ID NO: 34241 - RNA, 1701 nt, Artificial Sequence; identical to SEQ ID NO: 33173
  hemagglutinin__InfluenzaA__ACZ17220

SEQ ID NO: 34242 - RNA, 1701 nt, Artificial Sequence
  hemagglutinin__InfluenzaA__ACZ17230
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaaaagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34243 - RNA, 1701 nt, Artificial Sequence; identical to SEQ ID NO: 33173
  hemagglutinin__InfluenzaA__ACZ17240

SEQ ID NO: 34244 - RNA, 1701 nt, Artificial Sequence; identical to SEQ ID NO: 33206
  hemagglutinin__InfluenzaA__ACZ17250

SEQ ID NO: 34245 - RNA, 1701 nt, Artificial Sequence; identical to SEQ ID NO: 33173
  hemagglutinin__InfluenzaA__ACZ17260

SEQ ID NO: 34246 - RNA, 1701 nt, Artificial Sequence
  hemagglutinin__InfluenzaA__ACZ17270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguagauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 34247 - RNA, 1701 nt, Artificial Sequence
  hemagglutinin__InfluenzaA__ACZ17290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaacgcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34248 - RNA, 1701 nt, Artificial Sequence; identical to SEQ ID NO: 34247
  hemagglutinin__InfluenzaA__ACZ17300

SEQ ID NO: 34249 - RNA, 1701 nt, Artificial Sequence; identical to SEQ ID NO: 34247
  hemagglutinin__InfluenzaA__ACZ17310

SEQ ID NO: 34250 - RNA, 1701 nt, Artificial Sequence; identical to SEQ ID NO: 33173
  hemagglutinin__InfluenzaA__ACZ17398

SEQ ID NO: 34251 - RNA, 1701 nt, Artificial Sequence
  hemagglutinin__InfluenzaA__ACZ17408
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccacccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccagcucauugguacugguagucucccugggggcaaucaguuucuggaugugcucuaaugggucucuacaguguagaauauguauuuaa

SEQ ID NO: 34252 - RNA, 1701 nt, Artificial Sequence; identical to SEQ ID NO: 33173
  hemagglutinin__InfluenzaA__ACZ17418

SEQ ID NO: 34253 - RNA, 1701 nt, Artificial Sequence
  hemagglutinin__InfluenzaA__ACZ17438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggguaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34254 - RNA, 1701 nt, Artificial Sequence
  hemagglutinin__InfluenzaA__ACZ17448
augaaggcaauacuaguaguucugcuauauacauuugcgaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcguucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34255 - RNA, 1701 nt, Artificial Sequence; identical to SEQ ID NO: 33173
  hemagglutinin__InfluenzaA__ACZ17458

SEQ ID NO: 34256 - RNA, 1701 nt, Artificial Sequence; identical to SEQ ID NO: 33168
  hemagglutinin__InfluenzaA__ACZ17478

SEQ ID NO: 34257 - RNA, 1701 nt, Artificial Sequence; identical to SEQ ID NO: 33173
  hemagglutinin__InfluenzaA__ACZ17488

SEQ ID NO: 34258 - RNA, 1701 nt, Artificial Sequence
  hemagglutinin__InfluenzaA__ACZ18240
augaaggcaauacuagugguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaacaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34259 - RNA, 1701 nt, Artificial Sequence
  hemagglutinin__InfluenzaA__ACZ18241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34260 - RNA, 1701 nt, Artificial Sequence
  hemagglutinin__InfluenzaA__ACZ27800
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggggauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaaggaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34261 - RNA, 1701 nt, Artificial Sequence; identical to SEQ ID NO: 33173
  hemagglutinin__InfluenzaA__ACZ27810

SEQ ID NO: 34262 - RNA, 1701 nt, Artificial Sequence; identical to SEQ ID NO: 33206
  hemagglutinin__InfluenzaA__ACZ27820

SEQ ID NO: 34263 - RNA, 1701 nt, Artificial Sequence
  hemagglutinin__InfluenzaA__ACZ27830
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34264 - RNA, 1701 nt, Artificial Sequence
  hemagglutinin__InfluenzaA__ACZ27840
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34265 - RNA, 1701 nt, Artificial Sequence
  hemagglutinin__InfluenzaA__ACZ45006
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagggggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34266 - RNA, 1701 nt, Artificial Sequence
  hemagglutinin__InfluenzaA__ACZ45007
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggagaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34267 - RNA, 1701 nt, Artificial Sequence; identical to SEQ ID NO: 34264
  hemagglutinin__InfluenzaA__ACZ45008

SEQ ID NO: 34268 - RNA, 1701 nt, Artificial Sequence; identical to SEQ ID NO: 34264
  hemagglutinin__InfluenzaA__ACZ45009

SEQ ID NO: 34269 - RNA, 1701 nt, Artificial Sequence; identical to SEQ ID NO: 33457
  hemagglutinin__InfluenzaA__ACZ45010

SEQ ID NO: 34270 - RNA, 1701 nt, Artificial Sequence
  hemagglutinin__InfluenzaA__ACZ45012
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34271 - RNA, 1701 nt, Artificial Sequence
  hemagglutinin__InfluenzaA__ACZ45013
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgagcaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34272 - RNA, 1701 nt, Artificial Sequence
  hemagglutinin__InfluenzaA__ACZ45014
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugggucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34273 - RNA, 1701 nt, Artificial Sequence
  hemagglutinin__InfluenzaA__ACZ45016
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34274 - RNA, 1701 nt, Artificial Sequence
  hemagglutinin__InfluenzaA__ACZ45028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34275 - RNA, 1701 nt, Artificial Sequence
  hemagglutinin__InfluenzaA__ACZ45029
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaccuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugauggcuuccuggacauuuggacuuacaaugccgaacuguugguucuauuggaaaaugaaagaacuuuggacuaccacgauucaaaugugaagaauuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34276 - RNA, 1701 nt, Artificial Sequence
  hemagglutinin__InfluenzaA__ACZ45030
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaacauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34277 - RNA, 1701 nt, Artificial Sequence
  hemagglutinin__InfluenzaA__ACZ45031
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucacaauggaaagaaauguuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34278 - RNA, 1701 nt, Artificial Sequence
  hemagglutinin__InfluenzaA__ACZ45034
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgccuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34279 - RNA, 1701 nt, Artificial Sequence; identical to SEQ ID NO: 33206
  hemagglutinin__InfluenzaA__ACZ45036

SEQ ID NO: 34280 - RNA, 1701 nt, Artificial Sequence; identical to SEQ ID NO: 33206
  hemagglutinin__InfluenzaA__ACZ45037

SEQ ID NO: 34281 - RNA, 1701 nt, Artificial Sequence
  hemagglutinin__InfluenzaA__ACZ45038
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34282 - RNA, 1701 nt, Artificial Sequence
  hemagglutinin__InfluenzaA__ACZ45039
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugguacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34283 - RNA, 1701 nt, Artificial Sequence; identical to SEQ ID NO: 33173
  hemagglutinin__InfluenzaA__ACZ45040

SEQ ID NO: 34284 - RNA, 1701 nt, Artificial Sequence
  hemagglutinin__InfluenzaA__ACZ52567
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34285 - RNA, 1701 nt, Artificial Sequence; identical to SEQ ID NO: 33173
  hemagglutinin__InfluenzaA__ACZ52568

SEQ ID NO: 34286 - RNA, 1701 nt, Artificial Sequence
  hemagglutinin__InfluenzaA__ACZ52569
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagaugggugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34287 - RNA, 1701 nt, Artificial Sequence
  hemagglutinin__InfluenzaA__ACZ53956
augaagaccaucauugcuuugagcuacauuuucugucuggcucucgcucaaaaacuuccuggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguacauugaauugguugcaccaauuacaaaacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaagcuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccagagaggcaacauuaggugcaacauuugcauuuga

SEQ ID NO: 34288 - RNA, 1701 nt, Artificial Sequence
  hemagglutinin__InfluenzaA__ACZ53967
augaagaccaucauugcuuugagcuacauuuucugucuggcucucgcucaaaaacuuccuggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguacauugaauugguugcaccaauuacaaaacagauauccagcacugaacgugacuaugccaaacaaugacaaauuugacaaauuguacauuugggggguucaccacccgaguacggacagugaccaaaccagccuauaugcccaagcaucagggagagucacagucucuaccaaaagaagccaacaaacuguaaucccgaauaucggauccagacccuggguaaggggugucuccaguagaauaagcaucuauuggacaauaguuaagccgggagacguacugguaauuaauaguaaugggaaccuaaucgcuccucgggguuauuucaaaaugcgcagugggaaaagcucaauaaugaggucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcuggggucuaucaugugggccugccagagaggcaacauuaggugcaacauuugcauuuga

SEQ ID NO: 34289 - RNA, 1701 nt, Artificial Sequence
  hemagglutinin__InfluenzaA__ACZ53978
augaagaccaucauugcuuugagcuacauuuucugucuggcucucgcucaaaaacuuccuggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaagucacuaauugccucauccggcacccuggaguuuaacaaugaaagcuucaauuggauuggagucucucaaaauggaacaagcucugcuugcaaaaggauaucaauaacaguuucuuuuaauaaauugaauugguugcaccaauuaaaauacagauauccagcacugaacgugacuaugccaaacaaugacaaauuugacaaauuguacauuugggggguucaccacccgaguacggacagugaccaaaccagccuauaugcccaagcaucagggagagucacagucucuaccaaaagaagccaacaaacuguaaucccgaauaucggauccagacccuggguaaggggugucuccaguagaauaagcaucuauuggacaauaguuaagccgggagacguacugguaauuaauaguaaugggaaccuaaucgcuccucgggguuauuucaaaaugcgcagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaccgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccagagaggcaacauuaggugcaacauuugcauuuga

SEQ ID NO: 34290 - RNA, 1701 nt, Artificial Sequence
  hemagglutinin__InfluenzaA__ACZ56080
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34291 - RNA, 1701 nt, Artificial Sequence
  hemagglutinin__InfluenzaA__ACZ61118
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccaucaaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34292 - RNA, 1701 nt, Artificial Sequence
  hemagglutinin__InfluenzaA__ACZ61119
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuccccuuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34293 - RNA, 1701 nt, Artificial Sequence
  hemagglutinin__InfluenzaA__ACZ61122
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugguacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34294 - RNA, 1701 nt, Artificial Sequence
  hemagglutinin__InfluenzaA__ACZ61123
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacaagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34295 - RNA, 1701 nt, Artificial Sequence; identical to SEQ ID NO: 33971
  hemagglutinin__InfluenzaA__ACZ74627

SEQ ID NO: 34296 - RNA, 1698 nt, Artificial Sequence
  hemagglutinin__InfluenzaA__ACZ81554
augaaaguaaaacuacugguccuguuaugcacauuuacagcuacauaugcagacacaauauguauaggcuaccaugcuaacaacucgaccgauacuguugacacaguacuugaaaagaaugugacagugacacacucugucaaccugcuugagaacaaucacaauggaaaacuaugucuauuaaaaggaauagccccacuacaauuggguaacugcaccguugccggguggaucuuaggaaacccagaaugcgaauuacugauuuccaaggagucauggucuuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaauaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34297 - RNA, 1698 nt, Artificial Sequence
  hemagglutinin__InfluenzaA__ACZ81555
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaaucugcuauggcugacggggaagaaugguuuguacccaaaccugagcaaguccuaugcaaacaacaaagaaaaagaaguccuuguacuaugggguguucaucacccgccaaacauaggugaccaaaagacccucuaucauacagaaaaugcuuauguuucuguagugucuucacauuauagcagaaaauucaccccagaaauagccaaaagacccaaaguaagagaucaagaaggaagaaucaacuacuacugggcucugcuggaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcaguaggcaaagaauucaacaaauuggaaagaaggauggaaaacuugaauaagaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34298 - RNA, 1698 nt, Artificial Sequence
  hemagglutinin__InfluenzaA__ACZ81556
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaggaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgaagugccaaacaccucaaggagcuauaaacagcagucuuccuuuccagaacguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaaaaauggaacuuaugacuauccaaaauauuccgaagaaucaaaguuaaacaaggagaaaauugauggagugaaauuggaaucaaugggagucuaucagauucuagcgaucuacucaacagucgcaaguucucugguucuuuuggucucccugggggcaaucagcuucuggauguguuccaaugggucuuugcaguguagaauaugcaucuaa

SEQ ID NO: 34299 - RNA, 1701 nt, Artificial Sequence
  hemagglutinin__InfluenzaA__ACZ81557
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcuaguucagaguuccucaacaggugaaauaugcggcaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauaccaagcauuaaacgugacuaugccgaacaaugaacaauuugacaaauuguacauuugggggguucaccacccggguacggacaaagaccaaaucuuccuguaugcucaagcaucaggaagaaucacagucucuaccaaaagaagccaacaaacuguaaucccgaauaucggaucuagaccccgaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34300 - RNA, 1701 nt, Artificial Sequence
  hemagglutinin__InfluenzaA__ACZ81558
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauuaggagacccucauugugauggcuuccaaaauaagaaaugggaccuuuuuguugaacgcagcaaagccuacagcaacuguuacccuuaugaugugccggauuaugccucccuuaggucgcuaguugcuucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaaugugccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaauagaucaaaucaaugggaagcugaauagguugaucgagaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34301 - RNA, 1701 nt, Artificial Sequence
  hemagglutinin__InfluenzaA__ACZ81559
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugcuucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 34302 - RNA, 1701 nt, Artificial Sequence; identical to SEQ ID NO: 33173
  hemagglutinin__InfluenzaA__ACZ81632

SEQ ID NO: 34303 - RNA, 1701 nt, Artificial Sequence
  hemagglutinin__InfluenzaA__ACZ81642
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaauacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34304 - RNA, 1701 nt, Artificial Sequence
  hemagglutinin__InfluenzaA__ACZ81652
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcugaagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuagacauuuggacuuacaaugccgaacugcugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34305 - RNA, 1701 nt, Artificial Sequence
  hemagglutinin__InfluenzaA__ACZ92130
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauugaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34306 - RNA, 1701 nt, Artificial Sequence
  hemagglutinin__InfluenzaA__ACZ92131
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34307 - RNA, 1701 nt, Artificial Sequence; identical to SEQ ID NO: 33457
  hemagglutinin__InfluenzaA__ACZ92132

SEQ ID NO: 34308 - RNA, 1701 nt, Artificial Sequence; identical to SEQ ID NO: 33457
  hemagglutinin__InfluenzaA__ACZ92133

SEQ ID NO: 34309 - RNA, 1701 nt, Artificial Sequence; identical to SEQ ID NO: 33173
  hemagglutinin__InfluenzaA__ACZ92134

SEQ ID NO: 34310 - RNA, 1701 nt, Artificial Sequence
  hemagglutinin__InfluenzaA__ACZ95465
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaguaucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34311 - RNA, 1701 nt, Artificial Sequence
  hemagglutinin__InfluenzaA__ACZ95837
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcacaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34312 - RNA, 1701 nt, Artificial Sequence; identical to SEQ ID NO: 33173
  hemagglutinin__InfluenzaA__ACZ95847

SEQ ID NO: 34313 - RNA, 1701 nt, Artificial Sequence
  hemagglutinin__InfluenzaA__ACZ95857
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34314 - RNA, 1701 nt, Artificial Sequence; identical to SEQ ID NO: 33173
  hemagglutinin__InfluenzaA__ACZ95867

SEQ ID NO: 34315 - RNA, 1701 nt, Artificial Sequence
  hemagglutinin__InfluenzaA__ACZ95887
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34316 - RNA, 1701 nt, Artificial Sequence; identical to SEQ ID NO: 33173
  hemagglutinin__InfluenzaA__ACZ95897

SEQ ID NO: 34317 - RNA, 1701 nt, Artificial Sequence
  hemagglutinin__InfluenzaA__ACZ95907
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34318 - RNA, 1701 nt, Artificial Sequence
  hemagglutinin__InfluenzaA__ACZ95927
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcugagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccaccggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34319 - RNA, 1701 nt, Artificial Sequence
  hemagglutinin__InfluenzaA__ACZ95937
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggucaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34320 - RNA, 1701 nt, Artificial Sequence; identical to SEQ ID NO: 33457
  hemagglutinin__InfluenzaA__ACZ95947

SEQ ID NO: 34321 - RNA, 1701 nt, Artificial Sequence; identical to SEQ ID NO: 33173
  hemagglutinin__InfluenzaA__ACZ95957

SEQ ID NO: 34322 - RNA, 1701 nt, Artificial Sequence; identical to SEQ ID NO: 33457
  hemagglutinin__InfluenzaA__ACZ95967

SEQ ID NO: 34323 - RNA, 1701 nt, Artificial Sequence
  hemagglutinin__InfluenzaA__ACZ95977
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34324 - RNA, 1701 nt, Artificial Sequence
  hemagglutinin__InfluenzaA__ACZ95987
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugauagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34325 - RNA, 1701 nt, Artificial Sequence
  hemagglutinin__InfluenzaA__ACZ95997
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacacuagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34326 - RNA, 1701 nt, Artificial Sequence; identical to SEQ ID NO: 33206
  hemagglutinin__InfluenzaA__ACZ96007

SEQ ID NO: 34327 - RNA, 1701 nt, Artificial Sequence
  hemagglutinin__InfluenzaA__ACZ96017
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34328 - RNA, 1701 nt, Artificial Sequence
  hemagglutinin__InfluenzaA__ACZ96027
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagauaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34329 - RNA, 1701 nt, Artificial Sequence; identical to SEQ ID NO: 34323
  hemagglutinin__InfluenzaA__ACZ96047

SEQ ID NO: 34330 - RNA, 1701 nt, Artificial Sequence
  hemagglutinin__InfluenzaA__ACZ96057
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34331 - RNA, 1701 nt, Artificial Sequence
  hemagglutinin__InfluenzaA__ACZ96069
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggaaacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34332 - RNA, 1701 nt, Artificial Sequence; identical to SEQ ID NO: 34323
  hemagglutinin__InfluenzaA__ACZ96089

SEQ ID NO: 34333 - RNA, 1701 nt, Artificial Sequence
  hemagglutinin__InfluenzaA__ACZ96119
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacaccuaagggugcuauaaacaccagccucccauuucagaauauacauccgaucacaauuggaaaauguccaaaauauguaaaaagcacaaaauugagacuggccacaggcuugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34334 - RNA, 1701 nt, Artificial Sequence
  hemagglutinin__InfluenzaA__ACZ96129
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagaguucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34335 - RNA, 1701 nt, Artificial Sequence; identical to SEQ ID NO: 33206
  hemagglutinin__InfluenzaA__ACZ96149

SEQ ID NO: 34336 - RNA, 1701 nt, Artificial Sequence; identical to SEQ ID NO: 34325
  hemagglutinin__InfluenzaA__ACZ96159

SEQ ID NO: 34337 - RNA, 1701 nt, Artificial Sequence
  hemagglutinin__InfluenzaA__ACZ96179
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34338 - RNA, 1701 nt, Artificial Sequence; identical to SEQ ID NO: 34330
  hemagglutinin__InfluenzaA__ACZ96189

SEQ ID NO: 34339 - RNA, 1701 nt, Artificial Sequence
  hemagglutinin__InfluenzaA__ACZ96199
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34340 - RNA, 1701 nt, Artificial Sequence; identical to SEQ ID NO: 33472
  hemagglutinin__InfluenzaA__ACZ96209

SEQ ID NO: 34341 - RNA, 1701 nt, Artificial Sequence
  hemagglutinin__InfluenzaA__ACZ96219
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaaaauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagcuggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34342 - RNA, 1701 nt, Artificial Sequence; identical to SEQ ID NO: 33472
  hemagglutinin__InfluenzaA__ACZ96229

SEQ ID NO: 34343 - RNA, 1701 nt, Artificial Sequence
  hemagglutinin__InfluenzaA__ACZ96239
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34344 - RNA, 1701 nt, Artificial Sequence; identical to SEQ ID NO: 33206
  hemagglutinin__InfluenzaA__ACZ96249

SEQ ID NO: 34345 - RNA, 1701 nt, Artificial Sequence
  hemagglutinin__InfluenzaA__ACZ96269
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34346 - RNA, 1701 nt, Artificial Sequence; identical to SEQ ID NO: 33173
  hemagglutinin__InfluenzaA__ACZ96299

SEQ ID NO: 34347 - RNA, 1701 nt, Artificial Sequence
  hemagglutinin__InfluenzaA__ACZ96309
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34348 - RNA, 1701 nt, Artificial Sequence
  hemagglutinin__InfluenzaA__ACZ96319
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguauauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34349 - RNA, 1701 nt, Artificial Sequence; identical to SEQ ID NO: 34348
  hemagglutinin__InfluenzaA__ACZ96329

SEQ ID NO: 34350 - RNA, 1701 nt, Artificial Sequence
  hemagglutinin__InfluenzaA__ACZ96339
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggcaacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauuaaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34351 - RNA, 1701 nt, Artificial Sequence
  hemagglutinin__InfluenzaA__ACZ96349
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucaaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34352 - RNA, 1701 nt, Artificial Sequence; identical to SEQ ID NO: 34348
  hemagglutinin__InfluenzaA__ACZ96359

SEQ ID NO: 34353 - RNA, 1701 nt, Artificial Sequence
  hemagglutinin__InfluenzaA__ACZ96372
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccagcaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34354 - RNA, 1701 nt, Artificial Sequence; identical to SEQ ID NO: 34348
  hemagglutinin__InfluenzaA__ACZ96382

SEQ ID NO: 34355 - RNA, 1701 nt, Artificial Sequence
  hemagglutinin__InfluenzaA__ACZ96392
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34356 - RNA, 1701 nt, Artificial Sequence
  hemagglutinin__InfluenzaA__ACZ96405
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgauuacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34357 - RNA, 1701 nt, Artificial Sequence
  hemagglutinin__InfluenzaA__ACZ96415
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34358 - RNA, 1701 nt, Artificial Sequence
  hemagglutinin__InfluenzaA__ACZ96425
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34359 - RNA, 1701 nt, Artificial Sequence
  hemagglutinin__InfluenzaA__ACZ96435
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagcccaauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34360 - RNA, 1701 nt, Artificial Sequence
  hemagglutinin__InfluenzaA__ACZ96445
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggagagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34361 - RNA, 1701 nt, Artificial Sequence
  hemagglutinin__InfluenzaA__ACZ96476
augaaggcaauacuaguaguucugcuauauacauuugcaaccgcauaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34362 - RNA, 1701 nt, Artificial Sequence; identical to SEQ ID NO: 34325
  hemagglutinin__InfluenzaA__ACZ96496

SEQ ID NO: 34363 - RNA, 1701 nt, Artificial Sequence
  hemagglutinin__InfluenzaA__ACZ96506
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34364 - RNA, 1701 nt, Artificial Sequence; identical to SEQ ID NO: 34325
  hemagglutinin__InfluenzaA__ACZ96526

SEQ ID NO: 34365 - RNA, 1701 nt, Artificial Sequence
  hemagglutinin__InfluenzaA__ACZ96536
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaacauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 34366 - RNA, 1701 nt, Artificial Sequence
  hemagglutinin__InfluenzaA__ACZ96549
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccagcaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34367 - RNA, 1701 nt, Artificial Sequence
  hemagglutinin__InfluenzaA__ACZ96559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34368 - RNA, 1701 nt, Artificial Sequence
  hemagglutinin__InfluenzaA__ACZ96569
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34369 - RNA, 1701 nt, Artificial Sequence
  hemagglutinin__InfluenzaA__ACZ96579
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuucuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaaugcccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34370 - RNA, 1701 nt, Artificial Sequence; identical to SEQ ID NO: 34357
  hemagglutinin__InfluenzaA__ACZ96589

SEQ ID NO: 34371 - RNA, 1701 nt, Artificial Sequence
  hemagglutinin__InfluenzaA__ACZ96599
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34372 - RNA, 1701 nt, Artificial Sequence
  hemagglutinin__InfluenzaA__ACZ96609
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaacauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34373 - RNA, 1701 nt, Artificial Sequence; identical to SEQ ID NO: 34247
  hemagglutinin__InfluenzaA__ACZ96619

SEQ ID NO: 34374 - RNA, 1701 nt, Artificial Sequence; identical to SEQ ID NO: 34247
  hemagglutinin__InfluenzaA__ACZ96629

SEQ ID NO: 34375 - RNA, 1701 nt, Artificial Sequence; identical to SEQ ID NO: 34247
  hemagglutinin__InfluenzaA__ACZ96639

SEQ ID NO: 34376 - RNA, 1701 nt, Artificial Sequence; identical to SEQ ID NO: 34247
  hemagglutinin__InfluenzaA__ACZ96649

SEQ ID NO: 34377 - RNA, 1701 nt, Artificial Sequence; identical to SEQ ID NO: 34247
  hemagglutinin__InfluenzaA__ACZ96659

SEQ ID NO: 34378 - RNA, 1701 nt, Artificial Sequence; identical to SEQ ID NO: 34247
  hemagglutinin__InfluenzaA__ACZ96669

SEQ ID NO: 34379 - RNA, 1701 nt, Artificial Sequence; identical to SEQ ID NO: 34247
  hemagglutinin__InfluenzaA__ACZ96679

SEQ ID NO: 34380 - RNA, 1701 nt, Artificial Sequence; identical to SEQ ID NO: 34247
  hemagglutinin__InfluenzaA__ACZ96689

SEQ ID NO: 34381 - RNA, 1701 nt, Artificial Sequence; identical to SEQ ID NO: 34247
  hemagglutinin__InfluenzaA__ACZ96699

SEQ ID NO: 34382 - RNA, 1701 nt, Artificial Sequence; identical to SEQ ID NO: 34247
  hemagglutinin__InfluenzaA__ACZ96719

SEQ ID NO: 34383 - RNA, 1701 nt, Artificial Sequence; identical to SEQ ID NO: 34247
  hemagglutinin__InfluenzaA__ACZ96729

SEQ ID NO: 34384 - RNA, 1701 nt, Artificial Sequence; identical to SEQ ID NO: 34247
  hemagglutinin__InfluenzaA__ACZ96739

SEQ ID NO: 34385 - RNA, 1701 nt, Artificial Sequence
  hemagglutinin__InfluenzaA__ACZ96749
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34386 - RNA, 1701 nt, Artificial Sequence; identical to SEQ ID NO: 33315
  hemagglutinin__InfluenzaA__ACZ96759

SEQ ID NO: 34387 - RNA, 1701 nt, Artificial Sequence; identical to SEQ ID NO: 33315
  hemagglutinin__InfluenzaA__ACZ96769

SEQ ID NO: 34388 - RNA, 1701 nt, Artificial Sequence; identical to SEQ ID NO: 33168
  hemagglutinin__InfluenzaA__ACZ96779

SEQ ID NO: 34389 - RNA, 1701 nt, Artificial Sequence; identical to SEQ ID NO: 33168
  hemagglutinin__InfluenzaA__ACZ96789

SEQ ID NO: 34390 - RNA, 1701 nt, Artificial Sequence
  hemagglutinin__InfluenzaA__ACZ96809
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucgcagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34391 - RNA, 1701 nt, Artificial Sequence
  hemagglutinin__InfluenzaA__ACZ96819
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcguucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34392 - RNA, 1701 nt, Artificial Sequence; identical to SEQ ID NO: 33168
  hemagglutinin__InfluenzaA__ACZ96829

SEQ ID NO: 34393 - RNA, 1701 nt, Artificial Sequence; identical to SEQ ID NO: 33168
  hemagglutinin__InfluenzaA__ACZ96839

SEQ ID NO: 34394 - RNA, 1701 nt, Artificial Sequence; identical to SEQ ID NO: 34313
  hemagglutinin__InfluenzaA__ACZ96849

SEQ ID NO: 34395 - RNA, 1701 nt, Artificial Sequence; identical to SEQ ID NO: 33173
  hemagglutinin__InfluenzaA__ACZ96859

SEQ ID NO: 34396 - RNA, 1701 nt, Artificial Sequence
  hemagglutinin__InfluenzaA__ACZ96869
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34397 - RNA, 1701 nt, Artificial Sequence; identical to SEQ ID NO: 34391
  hemagglutinin__InfluenzaA__ACZ96879

SEQ ID NO: 34398 - RNA, 1701 nt, Artificial Sequence
  hemagglutinin__InfluenzaA__ACZ96899
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauucaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34399 - RNA, 1701 nt, Artificial Sequence
  hemagglutinin__InfluenzaA__ACZ96909
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaaggaggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 34400 - RNA, 1701 nt, Artificial Sequence; identical to SEQ ID NO: 34399
  hemagglutinin__InfluenzaA__ACZ96919

SEQ ID NO: 34401 - RNA, 1701 nt, Artificial Sequence; identical to SEQ ID NO: 34179
  hemagglutinin__InfluenzaA__ACZ96929

SEQ ID NO: 34402 - RNA, 1701 nt, Artificial Sequence; identical to SEQ ID NO: 33197
  hemagglutinin__InfluenzaA__ACZ96939

SEQ ID NO: 34403 - RNA, 1701 nt, Artificial Sequence
  hemagglutinin__InfluenzaA__ACZ96949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaauauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaaauguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 34404 - RNA, 1701 nt, Artificial Sequence
  hemagglutinin__InfluenzaA__ACZ97021
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaauauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauaugcauuuaa

SEQ ID NO: 34405 - RNA, 1701 nt, Artificial Sequence
  hemagglutinin__InfluenzaA__ACZ97343
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34406 - RNA, 1701 nt, Artificial Sequence; identical to SEQ ID NO: 34405
  hemagglutinin__InfluenzaA__ACZ97353

SEQ ID NO: 34407 - RNA, 1701 nt, Artificial Sequence
  hemagglutinin__InfluenzaA__ACZ97363
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 34408 - RNA, 1701 nt, Artificial Sequence
  hemagglutinin__InfluenzaA__ACZ97383
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuacuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 34409 - RNA, 1701 nt, Artificial Sequence; identical to SEQ ID NO: 33197
  hemagglutinin__InfluenzaA__ACZ97393

SEQ ID NO: 34410 - RNA, 1701 nt, Artificial Sequence
  hemagglutinin__InfluenzaA__ACZ98178
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauuacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34411 - RNA, 1701 nt, Artificial Sequence
  hemagglutinin__InfluenzaA__ACZ98188
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagguaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34412 - RNA, 1701 nt, Artificial Sequence; identical to SEQ ID NO: 33753
  hemagglutinin__InfluenzaA__ACZ98198

SEQ ID NO: 34413 - RNA, 1701 nt, Artificial Sequence; identical to SEQ ID NO: 33173
  hemagglutinin__InfluenzaA__ACZ98208

SEQ ID NO: 34414 - RNA, 1701 nt, Artificial Sequence; identical to SEQ ID NO: 33173
  hemagglutinin__InfluenzaA__ACZ98218

SEQ ID NO: 34415 - RNA, 1701 nt, Artificial Sequence; identical to SEQ ID NO: 33206
  hemagglutinin__InfluenzaA__ACZ98228

SEQ ID NO: 34416 - RNA, 1701 nt, Artificial Sequence
  hemagglutinin__InfluenzaA__ACZ98238
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34417 - RNA, 1701 nt, Artificial Sequence; identical to SEQ ID NO: 34236
  hemagglutinin__InfluenzaA__ACZ98248

SEQ ID NO: 34418 - RNA, 1701 nt, Artificial Sequence; identical to SEQ ID NO: 33173
  hemagglutinin__InfluenzaA__ACZ98258

SEQ ID NO: 34419 - RNA, 1701 nt, Artificial Sequence; identical to SEQ ID NO: 33173
  hemagglutinin__InfluenzaA__ACZ98268

SEQ ID NO: 34420 - RNA, 1701 nt, Artificial Sequence; identical to SEQ ID NO: 34313
  hemagglutinin__InfluenzaA__ACZ98278

SEQ ID NO: 34421 - RNA, 1701 nt, Artificial Sequence; identical to SEQ ID NO: 34313
  hemagglutinin__InfluenzaA__ACZ98288

SEQ ID NO: 34422 - RNA, 1701 nt, Artificial Sequence
  hemagglutinin__InfluenzaA__ACZ98298
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34423 - RNA, 1701 nt, Artificial Sequence
  hemagglutinin__InfluenzaA__ACZ98318
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccauauuuuggcgaucuauucaacugucgccaguucauugguacugguagucucccugggggcaaucaguuucuggaugugcucuaaugggucucuacaguguagaauauguauuuaa

SEQ ID NO: 34424 - RNA, 1701 nt, Artificial Sequence; identical to SEQ ID NO: 34356
  hemagglutinin__InfluenzaA__ACZ98328

SEQ ID NO: 34425 - RNA, 1701 nt, Artificial Sequence; identical to SEQ ID NO: 33173
  hemagglutinin__InfluenzaA__ACZ98338

SEQ ID NO: 34426 - RNA, 1701 nt, Artificial Sequence; identical to SEQ ID NO: 34313
  hemagglutinin__InfluenzaA__ACZ98348

SEQ ID NO: 34427 - RNA, 1701 nt, Artificial Sequence; identical to SEQ ID NO: 33173
  hemagglutinin__InfluenzaA__ACZ98358

SEQ ID NO: 34428 - RNA, 1701 nt, Artificial Sequence; identical to SEQ ID NO: 33173
  hemagglutinin__InfluenzaA__ACZ98368

SEQ ID NO: 34429 - RNA, 1701 nt, Artificial Sequence; identical to SEQ ID NO: 33457
  hemagglutinin__InfluenzaA__ACZ98388

SEQ ID NO: 34430 - RNA, 1701 nt, Artificial Sequence
  hemagglutinin__InfluenzaA__ACZ98398
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccagcucauugguacugguagucucccugggggcaaucaguuucuggaugugcucuaaugggucucuacaguguagaauauguauuuaa

SEQ ID NO: 34431 - RNA, 1701 nt, Artificial Sequence; identical to SEQ ID NO: 33173
  hemagglutinin__InfluenzaA__ACZ98408

SEQ ID NO: 34432 - RNA, 1701 nt, Artificial Sequence; identical to SEQ ID NO: 34247
  hemagglutinin__InfluenzaA__ACZ98418

SEQ ID NO: 34433 - RNA, 1701 nt, Artificial Sequence; identical to SEQ ID NO: 33173
  hemagglutinin__InfluenzaA__ACZ98428

SEQ ID NO: 34434 - RNA, 1701 nt, Artificial Sequence; identical to SEQ ID NO: 33173
  hemagglutinin__InfluenzaA__ACZ98438

SEQ ID NO: 34435 - RNA, 1701 nt, Artificial Sequence; identical to SEQ ID NO: 33173
  hemagglutinin__InfluenzaA__ACZ98448

SEQ ID NO: 34436 - RNA, 1701 nt, Artificial Sequence; identical to SEQ ID NO: 34313
  hemagglutinin__InfluenzaA__ACZ98458

SEQ ID NO: 34437 - RNA, 1701 nt, Artificial Sequence
  hemagglutinin__InfluenzaA__ACZ98546
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacugaccacaggauugaggaauguaccgucuauucaauauagaggcuuauuuggggccaucaccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34438 - RNA, 1701 nt, Artificial Sequence
  hemagglutinin__InfluenzaA__ACZ98560
augaaggcaauacgaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcccaaaauugagacuggccacaggaaugaggaauguaccguuuauucaauauagaggccuauuuggggccauuaccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34439 - RNA, 1701 nt, Artificial Sequence
  hemagglutinin__InfluenzaA__ACZ98567
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcccaaaauugagacuggccucaggcaugaggaauguaccguuuauucaaucuagaggccuauuuggggccaucaccgguuucauugaagagggguggacagggaugguagauggaugguacgguuuucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34440 - RNA, 1701 nt, Artificial Sequence; identical to SEQ ID NO: 34391
  hemagglutinin__InfluenzaA__ACZ98671

SEQ ID NO: 34441 - RNA, 1701 nt, Artificial Sequence; identical to SEQ ID NO: 33197
  hemagglutinin__InfluenzaA__ACZ98681

SEQ ID NO: 34442 - RNA, 1701 nt, Artificial Sequence; identical to SEQ ID NO: 33472
  hemagglutinin__InfluenzaA__ACZ98691

SEQ ID NO: 34443 - RNA, 1701 nt, Artificial Sequence
  hemagglutinin__InfluenzaA__ADA60799
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34444 - RNA, 1701 nt, Artificial Sequence
  hemagglutinin__InfluenzaA__ADA69302
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34445 - RNA, 1701 nt, Artificial Sequence; identical to SEQ ID NO: 34444
  hemagglutinin__InfluenzaA__ADA69312

SEQ ID NO: 34446 - RNA, 1701 nt, Artificial Sequence; identical to SEQ ID NO: 34444
  hemagglutinin__InfluenzaA__ADA69322

SEQ ID NO: 34447 - RNA, 1701 nt, Artificial Sequence; identical to SEQ ID NO: 34444
  hemagglutinin__InfluenzaA__ADA69332

SEQ ID NO: 34448 - RNA, 1701 nt, Artificial Sequence; identical to SEQ ID NO: 34274
  hemagglutinin__InfluenzaA__ADA70329

SEQ ID NO: 34449 - RNA, 1698 nt, Artificial Sequence
  hemagglutinin__InfluenzaA__ADA71150
augaaaguaaaacuacugguccuguuaugcacauuuacagcuacauaugcagacacaauauguauaggcuaccaugcuaacaacucgaccgacacuguugacacaguacuugaaaagaaugugacagugacccacucugucaaccugguugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaaaaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccagcuaaagaauaaugcuaaagaaauaggaaauggguguuuugaauucuaucacaaguguaacgaugaaugcauggagaguguaaagaauggaacuuaugacuauccaaaauacuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 34450 - RNA, 1701 nt, Artificial Sequence
  hemagglutinin__InfluenzaA__ADA71152
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaggaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34451 - RNA, 1698 nt, Artificial Sequence
  hemagglutinin__InfluenzaA__ADA71154
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaauucagaaugcgaauuacugauuuccaaggagucaugguccuacauuguagaaaaaccaaauccugagaauggaacauguuacuucgggcauuucgcugacuaugaggaacugagggagcaauuugguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaucaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccagggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauucugaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34452 - RNA, 1698 nt, Artificial Sequence
  hemagglutinin__InfluenzaA__ADA71158
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagacaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaagcauaaaugaucaaaggacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccagggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaccccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaaguuugauggauaucuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34453 - RNA, 1701 nt, Artificial Sequence
  hemagglutinin__InfluenzaA__ADA71162
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34454 - RNA, 1698 nt, Artificial Sequence
  hemagglutinin__InfluenzaA__ADA71164
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccauuacaauuggguaacugcagcguugccggguggaucuuaggaaacccagaaugcgaauuacugguuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaagcauagcugaucaaaagacccucuaucauacagaaaaugcuuauguuucuguagugucuucacauuauagcagaaaauucaccccagaaauagccaaaagacccaaaguaagagaucaagaaggaagaauccacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgacgugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaauaagccaguuaaagauuaaugcuaaagauuuaggauauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34455 - RNA, 1698 nt, Artificial Sequence
  hemagglutinin__InfluenzaA__ADA71168
augaaaguaaaacuacugguccuguuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaaaagccccauuacaauuggguaacugcagcguugccggguggaucuuaggaaacccagaaugcggauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauagguguccaaaugacccucuaucauaaagaaaaugcuuaugucucuguagugucuucacauuauagcagaaaauucaccccagaaauagucaaaagacccaaaguaagagaucaagaaggaagaaucaacuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34456 - RNA, 1698 nt, Artificial Sequence
  hemagglutinin__InfluenzaA__ADA71170
augaaaguaaaacuacugguccuguuaugcacauuuacagcuacauaugcagacacaauauguauaggcuaccaugcuaacaacucgaccgacacuguugacacaguacuugaaaagaaugggacagugacccccucuggcaaccugguugaaaacagucccaauggaaaacuuugucuauuaaaaggaauaaccccauuacaauuggguaaaugcagcguugccggguggaucuuaggaaacccaaaaugggaauuacugguuuccaaggagucaugguccuacauuggaaaaaaaccaaauccugaaaauggaacauguuacccagggcauuucccuuacuaugaagaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34457 - RNA, 1701 nt, Artificial Sequence
  hemagglutinin__InfluenzaA__ADA71172
augaagacuaucauugcuuugagcuacauucuaugucugguuuucacucaaaaacuuccuggaaaugacaacagcacggcaacgcugugccuugggcaccaugcaguaccaaacggaacgauagugaaaacaaucacgaaugaccaaauugaaguuacuaacgcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaaugugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacaggaaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34458 - RNA, 1698 nt, Artificial Sequence
  hemagglutinin__InfluenzaA__ADA71176
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagcgucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcuaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguaggggcuuuggaucaggaaucaucaacucaaaugcaccaauggauaaaugugaugcgacgugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34459 - RNA, 1701 nt, Artificial Sequence
  hemagglutinin__InfluenzaA__ADA71181
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34460 - RNA, 1701 nt, Artificial Sequence
  hemagglutinin__InfluenzaA__ADA71191
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34461 - RNA, 1701 nt, Artificial Sequence
  hemagglutinin__InfluenzaA__ADA79587
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34462 - RNA, 1701 nt, Artificial Sequence
  hemagglutinin__InfluenzaA__ADA79607
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaggcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacaccaaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34463 - RNA, 1701 nt, Artificial Sequence
  hemagglutinin__InfluenzaA__ADA83043
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34464 - RNA, 1701 nt, Artificial Sequence
  hemagglutinin__InfluenzaA__ADA83044
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaaacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucaacaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucagaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34465 - RNA, 1701 nt, Artificial Sequence; identical to SEQ ID NO: 33173
  hemagglutinin__InfluenzaA__ADA83580

SEQ ID NO: 34466 - RNA, 1701 nt, Artificial Sequence; identical to SEQ ID NO: 33173
  hemagglutinin__InfluenzaA__ADA83587

SEQ ID NO: 34467 - RNA, 1701 nt, Artificial Sequence
  hemagglutinin__InfluenzaA__ADA83591
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaucaauaagacccaaagugagggaucaagaagguagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34468 - RNA, 1701 nt, Artificial Sequence
  hemagglutinin__InfluenzaA__ADA83595
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34469 - RNA, 1701 nt, Artificial Sequence; identical to SEQ ID NO: 33173
  hemagglutinin__InfluenzaA__ADA83599

SEQ ID NO: 34470 - RNA, 1701 nt, Artificial Sequence; identical to SEQ ID NO: 33173
  hemagglutinin__InfluenzaA__ADA83603

SEQ ID NO: 34471 - RNA, 1701 nt, Artificial Sequence
  hemagglutinin__InfluenzaA__ADA83611
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34472 - RNA, 1701 nt, Artificial Sequence
  hemagglutinin__InfluenzaA__ADA83615
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauuuaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34473 - RNA, 1701 nt, Artificial Sequence
  hemagglutinin__InfluenzaA__ADA83622
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaacgucucuaucagaaugcagaugcauauguuuuuguggggacaucaagauacagcaagaagcucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34474 - RNA, 1701 nt, Artificial Sequence; identical to SEQ ID NO: 33173
  hemagglutinin__InfluenzaA__ADA83633

SEQ ID NO: 34475 - RNA, 1701 nt, Artificial Sequence
  hemagglutinin__InfluenzaA__ADA83637
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34476 - RNA, 1701 nt, Artificial Sequence; identical to SEQ ID NO: 33173
  hemagglutinin__InfluenzaA__ADA83641

SEQ ID NO: 34477 - RNA, 1701 nt, Artificial Sequence
  hemagglutinin__InfluenzaA__ADA83645
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggagauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 34478 - RNA, 1701 nt, Artificial Sequence
  hemagglutinin__InfluenzaA__ADA83648
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggauucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34479 - RNA, 1701 nt, Artificial Sequence
  hemagglutinin__InfluenzaA__ADA83656
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34480 - RNA, 1701 nt, Artificial Sequence; identical to SEQ ID NO: 33173
  hemagglutinin__InfluenzaA__ADA83660

SEQ ID NO: 34481 - RNA, 1701 nt, Artificial Sequence
  hemagglutinin__InfluenzaA__ADA83664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaacagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggagauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34482 - RNA, 1701 nt, Artificial Sequence
  hemagglutinin__InfluenzaA__ADA83668
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaguguggaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34483 - RNA, 1701 nt, Artificial Sequence; identical to SEQ ID NO: 33173
  hemagglutinin__InfluenzaA__ADA83672

SEQ ID NO: 34484 - RNA, 1701 nt, Artificial Sequence; identical to SEQ ID NO: 33173
  hemagglutinin__InfluenzaA__ADA83676

SEQ ID NO: 34485 - RNA, 1701 nt, Artificial Sequence
  hemagglutinin__InfluenzaA__ADA83680
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34486 - RNA, 1701 nt, Artificial Sequence
  hemagglutinin__InfluenzaA__ADA86068
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcauaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggaucuaccagauuuuggcgaucuauucaacugucgccaguucauugguacugguagucucccugggggcaaucaguuucuggaugugcucuaaugggucucuacaguguagaauauguauuuaa

SEQ ID NO: 34487 - RNA, 1701 nt, Artificial Sequence
  hemagglutinin__InfluenzaA__ADA86086
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauccaccauccaucuacuaaugcugaccaacaaagucucuaucagaaugcagaugcauauguuuuuguggggacaucaagauacagcaagaaguucaagccggaaauagcaauaagacccaaagugagggaccaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34488 - RNA, 1701 nt, Artificial Sequence
  hemagglutinin__InfluenzaA__ADA86087
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacauuuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuuuaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 34489 - RNA, 1701 nt, Artificial Sequence
  hemagglutinin__InfluenzaA__ADA86088
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34490 - RNA, 1701 nt, Artificial Sequence
  hemagglutinin__InfluenzaA__ADB03603
augaaggcaauacuaauaguucugcuauauacauuugcaaccgcacaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34491 - RNA, 1701 nt, Artificial Sequence
  hemagglutinin__InfluenzaA__ADB03604
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34492 - RNA, 1701 nt, Artificial Sequence
  hemagglutinin__InfluenzaA__ADB03605
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaauggacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34493 - RNA, 1701 nt, Artificial Sequence
  hemagglutinin__InfluenzaA__ADB03607
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34494 - RNA, 1701 nt, Artificial Sequence; identical to SEQ ID NO: 34264
  hemagglutinin__InfluenzaA__ADB03609

SEQ ID NO: 34495 - RNA, 1701 nt, Artificial Sequence
  hemagglutinin__InfluenzaA__ADB03611
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 34496 - RNA, 1701 nt, Artificial Sequence
  hemagglutinin__InfluenzaA__ADB03612
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguuuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34497 - RNA, 1701 nt, Artificial Sequence; identical to SEQ ID NO: 34013
  hemagglutinin__InfluenzaA__ADB03614

SEQ ID NO: 34498 - RNA, 1701 nt, Artificial Sequence
  hemagglutinin__InfluenzaA__ADB03617
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34499 - RNA, 1701 nt, Artificial Sequence
  hemagglutinin__InfluenzaA__ADB03619
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauaugguuaguuaaaaaaggaaauucauacccaaagcucagcaaauccuacauuaaugauaaagggaaagaaguccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34500 - RNA, 1701 nt, Artificial Sequence
  hemagglutinin__InfluenzaA__ADB03620
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauaguccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34501 - RNA, 1701 nt, Artificial Sequence
  hemagglutinin__InfluenzaA__ADB03622
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34502 - RNA, 1701 nt, Artificial Sequence; identical to SEQ ID NO: 34501
  hemagglutinin__InfluenzaA__ADB03623

SEQ ID NO: 34503 - RNA, 1701 nt, Artificial Sequence
  hemagglutinin__InfluenzaA__ADB03628
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34504 - RNA, 1701 nt, Artificial Sequence
  hemagglutinin__InfluenzaA__ADB03629
augaaggcaauacuaguaguucugcuauauacauuuacaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccuggguaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuuucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34505 - RNA, 1701 nt, Artificial Sequence
  hemagglutinin__InfluenzaA__ADB03630
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34506 - RNA, 1701 nt, Artificial Sequence
  hemagglutinin__InfluenzaA__ADB25319
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34507 - RNA, 1701 nt, Artificial Sequence; identical to SEQ ID NO: 33173
  hemagglutinin__InfluenzaA__ADB25321

SEQ ID NO: 34508 - RNA, 1701 nt, Artificial Sequence
  hemagglutinin__InfluenzaA__ADB27970
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34509 - RNA, 1701 nt, Artificial Sequence; identical to SEQ ID NO: 33173
  hemagglutinin__InfluenzaA__ADB27980

SEQ ID NO: 34510 - RNA, 1701 nt, Artificial Sequence; identical to SEQ ID NO: 34259
  hemagglutinin__InfluenzaA__ADB54352

SEQ ID NO: 34511 - RNA, 1701 nt, Artificial Sequence
  hemagglutinin__InfluenzaA__ADB54355
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34512 - RNA, 1698 nt, Artificial Sequence
  hemagglutinin__InfluenzaA__ADB65926
augaaaguaaaacuacugguccuauuaugcacauuuacagcuacauaugcggacacaauauguaucggcuaccaugccaacaacucaaccgacacuguugacacaguacuugaaaagaaugugacagugacacacucugucaaccugcuugaggacaaacacaauggaaaacuaugucuauuaaaaggaaaagccccauuacaauuagguaacugcagcguugccggguggaucuuaggaaacccagaaugcggauuacugauuuccaaggagucaugguccuacauuguagaaagaccaaauccugagaauggaacauguuacccagggcauuucgccgacuaugaggaacugagggagcaauugaguucaguaucuucauuugagagguucgaaauauuccccaaaggaagcucauggcccaaccacaccguaaccggaguaucagcaucaugcucccauaacggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaaugggaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacauuccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaacucuguaauugagaagaugaacacucaauucacagcuguaggcaaagaauucaacaaauuggaaagaaggauggaaaacuuaaauaaaaaaguugaugacggguuuauagacguuuggacauacaaugcagaacuguugguucuacuggaaaaugaaaggacuuuggauuuccaugacuccaaugugaagaauuuguaugagaaaguaaaaaaccaauuaaaaaauaaugccaaagaaaugggaaauggguguuuugaauuuuaucacaaguguaacgaugaaugcauggagaguguaaaaaauggaacuuaugauuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucggcuucuggauguguuccaaugggucuuugcaguguagaauaugcaucuaa

SEQ ID NO: 34513 - RNA, 1698 nt, Artificial Sequence
  hemagglutinin__InfluenzaA__ADB80153
augaaaguaaaacuacuggcccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaauggggaaagcagcuuuuacaaaaauuugcuauggcugacgggaaagaaugguuuguacccaaaccugagcaaguccuuugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggaguacaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaaaccaauuaaagaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34514 - RNA, 1701 nt, Artificial Sequence; identical to SEQ ID NO: 34459
  hemagglutinin__InfluenzaA__ADB81399

SEQ ID NO: 34515 - RNA, 1701 nt, Artificial Sequence
  hemagglutinin__InfluenzaA__ADB81409
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34516 - RNA, 1701 nt, Artificial Sequence
  hemagglutinin__InfluenzaA__ADB81419
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccagaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34517 - RNA, 1701 nt, Artificial Sequence
  hemagglutinin__InfluenzaA__ADB81429
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34518 - RNA, 1701 nt, Artificial Sequence
  hemagglutinin__InfluenzaA__ADB81439
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34519 - RNA, 1701 nt, Artificial Sequence
  hemagglutinin__InfluenzaA__ADB81449
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34520 - RNA, 1701 nt, Artificial Sequence
  hemagglutinin__InfluenzaA__ADB81459
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugguggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34521 - RNA, 1701 nt, Artificial Sequence
  hemagglutinin__InfluenzaA__ADB82655
augaaggcaauacuauuagucuugcuaugcacacuugcagcagcaaaugcagacacacuguguauagguuaucaugcaaauaauucaacugacacuguugauacaguauuagaaaagaauguuacaguaacacacucuguuaaccuuuuagaagacagacacaauggaaaacuauguaaccuaagggggaaggccccacugcauuuggguaaauguaacauugccggauggcuccuaggaaacccagagugcgaauuacuauuugcaguaaacucauggucuuacauuguggaaacaucgaacucagacaaugggacauguuacccaggagauuucaccaguuaugaagagcuaagagaacaauugagcucagugucaucauuugaaagauucgaaauauuccccaaagcaagcucuuggcccaaccaugaaacaaacagagguguaacggcagcaugcccuuaugcuggaacaaacggcuucuacaggaauuugauauggcuaguaaaaaaggaaaacucauauccaaaacucagaaaauccuauguuaauaauaagaagaaggaaguccuuguacuauggggcauccaccauccacccaccaauacugaucaacaaagucucuaccagaaugcagaugccuauguuuuugugggaucaucaaaauauagcaggaaauucaaaccagaaauagcagaaagacccaaggugaggggucaagcaggaagaaugaacuauuauuggacauuaauagagccuggagacacaauaacauuugaagcaacuggaaaucuaguggcaccaagauaugcuuuugcaaugaauagagguccuguaucggguaucauaacaucggaugcaccaguccaugacuguaaugcgacuugucaaacacccaagggugccauaaacaccagccucccauuucagaauauucauccaaucacuauuggagaaugucccaaauaugucaaaagcacaagacuaagaauggcuacaggauuaagaaauaucccuucuauucaaucuagaggucuguuuggggccauugcugguuucauugaaggaggauggacagggaugauagaugggugguacgguuaucaucaucagaauggacaaggaucaggauaugcagcggaccaaaagagcacacagaaugccaucgauaggauaacuaacaagguaaauucuguuauugaaaagaugaacauacaauucacagcaguggguaaagaauuuaaccacuuagaaagaagaauagaaaacuuaaacaaaaagguugaugauggauuuuuggauguuuggacauacaaugccgaacuguuaguccuauuggaaaaugagagaacuuuggauuuccaugacucaaauguaaaaacccuauaugaaaagguaaaaacccagcuaaggaacaaugccaaagaaauugggaauggcugcuuugaauucuaucacaaaugugaugacacaugcauggagagcaucaaaaaugggacuuacaauuaccccaaauacucggaagaaucaaaacuaaacagagaggaaauagauggaguaaaacuggagucaacaaggauuuaccagauuuuggcgaucuauucaacugccgccaguucacugguacuguuggucucccugggggcaaucgguuucuggaugugcuccaaugggucuuugcagugcagaauauguauuuaa

SEQ ID NO: 34522 - RNA, 1701 nt, Artificial Sequence
  hemagglutinin__InfluenzaA__ADB82656
augaaggcaauacuauuagucuugcaauguauacuuacagccgcaaaugcagacacauuauguauagguuaccaugcaaauaauucaacugacacaguugauacaguauuagaaaagaauguaacaguaacacacucugugaaccuucuggaagacagacacaacgggaaauuauguaagcugaaagggauagccccauugcauuuggguaaauguaacauugcuggauggcuccuggggaacccagaaugugaauuacuauucaaagcaaacucauggucuuacauuguggaaacaucuuacucagacaaugggacauguuauccaggggauuucaccaauuacgaagaguugagagagcaguugagcucagugucaucauuugaaagguuugagauguuccccaaagcaaauucauggccuaaucaugaaacaaacaaaggugugacggcagcaugcccuuaugcuggagcaaacagcuucuacagaaacuuaauauggcugguaaaaaaaggaaauucauauccaaggcucagcaaauccuaugucaacaauaagaaaaaagagguccuugugcuauggggcauucaccacccaucuaccaguacugaucaacaaagucucuaccagaaugcagaugccuauguuuuugugagcucaucaacauacaacaagagauucaagccagaaauaggaacaagaccaaaggugagagaucaaucagggagaaugaauuauuacuggacaauaguagagccuggagacacaauaacauuugaagcaacuggaaaucuaguggcaccaagauacgcauucgcaaugaaaagagauucuggaucugguauuaucaugucagacacaccaguccacgauuguaacacaacuugucaaacaccuaaaggugcuauaaacaccagccucccauuucaaaauguacauccagucacaauuggggaauguccaaaauaugucaaaagcacaaaauuaagaauggcuacaggacuaaggaacaucccgucuauucaauccagaggucuguuuggagccauugcuggcuuuauugaagggggauggacaggaaugauagauggaugguacgguuaucaccaucagaaugagcaaggaucaggauaugcagcugaccgaaagagcacacagaaugccauugacgggaucacuaacaaagugaacucaauuauugaaaaaaugaacauacaauucacagcaguggguaaagaauucagccaucuggaaaaaaggguagagaauuuaaacaaaaagguugaugaugguuuucuagauguuuggacuuacaaugccgaacuguugguucuauuggaaaaugaaagaacuuuggauuaucaugacucaaaugugaaaaaccuauaugagaaaguaagaagccagcugaaaaacaaugccaaagaaauuggaaauggauguuuugaauuuuaccacaaaugugaugacucaugcauggagagcauuaaaaaugagacuuaugacuauucgaaguauucagaagaaucaagauuaaacagagagaaaauagauggagugaaauuggaaucaacacaaauuuaucagauuuuggcgaucuauucaacugucgccaguucauugguauuguuagucucccugggggcaaucaguuucuggaugugcuccaaugggucuuuacagugcagaauauguauuuaa

SEQ ID NO: 34523 - RNA, 1701 nt, Artificial Sequence
  hemagglutinin__InfluenzaA__ADB82944
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34524 - RNA, 1701 nt, Artificial Sequence
  hemagglutinin__InfluenzaA__ADB82950
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucgagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34525 - RNA, 1701 nt, Artificial Sequence
  hemagglutinin__InfluenzaA__ADB89129
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34526 - RNA, 1701 nt, Artificial Sequence
  hemagglutinin__InfluenzaA__ADB89139
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggcguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34527 - RNA, 1701 nt, Artificial Sequence
  hemagglutinin__InfluenzaA__ADB89149
augaaggcaauacuaguaguucugcuauauacauuugcaaccgcaaaugcauacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaguaucaucauuugaaagguuugagauauuccccaagacaaguucauggcccaaucaugacucgaacaaagguguaacggcagcauguccucauguuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34528 - RNA, 1701 nt, Artificial Sequence
  hemagglutinin__InfluenzaA__ADB89150
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34529 - RNA, 1701 nt, Artificial Sequence
  hemagglutinin__InfluenzaA__ADB89221
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuuuuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaaaucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34530 - RNA, 1701 nt, Artificial Sequence; identical to SEQ ID NO: 33229
  hemagglutinin__InfluenzaA__ADB89241

SEQ ID NO: 34531 - RNA, 1701 nt, Artificial Sequence; identical to SEQ ID NO: 33472
  hemagglutinin__InfluenzaA__ADB89251

SEQ ID NO: 34532 - RNA, 1701 nt, Artificial Sequence; identical to SEQ ID NO: 33620
  hemagglutinin__InfluenzaA__ADB89261

SEQ ID NO: 34533 - RNA, 1701 nt, Artificial Sequence
  hemagglutinin__InfluenzaA__ADB89271
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcaugggaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 34534 - RNA, 1701 nt, Artificial Sequence
  hemagglutinin__InfluenzaA__ADB89281
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34535 - RNA, 1701 nt, Artificial Sequence; identical to SEQ ID NO: 33206
  hemagglutinin__InfluenzaA__ADB89291

SEQ ID NO: 34536 - RNA, 1701 nt, Artificial Sequence
  hemagglutinin__InfluenzaA__ADB89301
augaaggcaauacuaguaguuuugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34537 - RNA, 1701 nt, Artificial Sequence
  hemagglutinin__InfluenzaA__ADB89311
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34538 - RNA, 1701 nt, Artificial Sequence
  hemagglutinin__InfluenzaA__ADB89321
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcgaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaagguugaugaugguuuccuggacauuuggacuuacaaugccgaacuguugguucuauuggaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34539 - RNA, 1701 nt, Artificial Sequence
  hemagglutinin__InfluenzaA__ADB89331
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 34540 - RNA, 1701 nt, Artificial Sequence; identical to SEQ ID NO: 34493
  hemagglutinin__InfluenzaA__ADB89341

SEQ ID NO: 34541 - RNA, 1701 nt, Artificial Sequence; identical to SEQ ID NO: 33173
  hemagglutinin__InfluenzaA__ADB89351

SEQ ID NO: 34542 - RNA, 1701 nt, Artificial Sequence; identical to SEQ ID NO: 34493
  hemagglutinin__InfluenzaA__ADB89361

SEQ ID NO: 34543 - RNA, 1701 nt, Artificial Sequence; identical to SEQ ID NO: 33173
  hemagglutinin__InfluenzaA__ADB89371

SEQ ID NO: 34544 - RNA, 1701 nt, Artificial Sequence
  hemagglutinin__InfluenzaA__ADB89381
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34545 - RNA, 1701 nt, Artificial Sequence
  hemagglutinin__InfluenzaA__ADB89391
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugucuucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugauagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34546 - RNA, 1701 nt, Artificial Sequence
  hemagglutinin__InfluenzaA__ADB89401
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucgagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34547 - RNA, 1701 nt, Artificial Sequence
  hemagglutinin__InfluenzaA__ADB89411
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34548 - RNA, 1701 nt, Artificial Sequence; identical to SEQ ID NO: 33620
  hemagglutinin__InfluenzaA__ADB89431

SEQ ID NO: 34549 - RNA, 1701 nt, Artificial Sequence
  hemagglutinin__InfluenzaA__ADB89441
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgcaaguucauugguacugguagucucccugggggcaaucaguuucuggaugugcucuaaugggucucuacaguguagaauauguauuuaa

SEQ ID NO: 34550 - RNA, 1701 nt, Artificial Sequence
  hemagglutinin__InfluenzaA__ADB89461
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacucugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34551 - RNA, 1701 nt, Artificial Sequence; identical to SEQ ID NO: 33620
  hemagglutinin__InfluenzaA__ADB89481

SEQ ID NO: 34552 - RNA, 1701 nt, Artificial Sequence
  hemagglutinin__InfluenzaA__ADB89491
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34553 - RNA, 1701 nt, Artificial Sequence
  hemagglutinin__InfluenzaA__ADB89501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggguugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34554 - RNA, 1701 nt, Artificial Sequence; identical to SEQ ID NO: 33173
  hemagglutinin__InfluenzaA__ADB89511

SEQ ID NO: 34555 - RNA, 1701 nt, Artificial Sequence; identical to SEQ ID NO: 33620
  hemagglutinin__InfluenzaA__ADB89531

SEQ ID NO: 34556 - RNA, 1701 nt, Artificial Sequence
  hemagglutinin__InfluenzaA__ADB89541
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaauccagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34557 - RNA, 1701 nt, Artificial Sequence
  hemagglutinin__InfluenzaA__ADB89551
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34558 - RNA, 1701 nt, Artificial Sequence; identical to SEQ ID NO: 33173
  hemagglutinin__InfluenzaA__ADB89561

SEQ ID NO: 34559 - RNA, 1701 nt, Artificial Sequence; identical to SEQ ID NO: 34493
  hemagglutinin__InfluenzaA__ADB89571

SEQ ID NO: 34560 - RNA, 1701 nt, Artificial Sequence; identical to SEQ ID NO: 33622
  hemagglutinin__InfluenzaA__ADB89581

SEQ ID NO: 34561 - RNA, 1701 nt, Artificial Sequence
  hemagglutinin__InfluenzaA__ADB89591
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacugggcacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34562 - RNA, 1701 nt, Artificial Sequence
  hemagglutinin__InfluenzaA__ADB89601
augaaggcaauaauaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugagagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuugacgaucuauucaacugucgccaguucauugguacugguagucucccugggggcaaucaguuucuggaugugcucuaaugggucucuacaguguagaauauguauuuaa

SEQ ID NO: 34563 - RNA, 1701 nt, Artificial Sequence
  hemagglutinin__InfluenzaA__ADB89611
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34564 - RNA, 1701 nt, Artificial Sequence; identical to SEQ ID NO: 34337
  hemagglutinin__InfluenzaA__ADB89621

SEQ ID NO: 34565 - RNA, 1701 nt, Artificial Sequence
  hemagglutinin__InfluenzaA__ADB89631
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34566 - RNA, 1701 nt, Artificial Sequence; identical to SEQ ID NO: 34337
  hemagglutinin__InfluenzaA__ADB89641

SEQ ID NO: 34567 - RNA, 1701 nt, Artificial Sequence; identical to SEQ ID NO: 33206
  hemagglutinin__InfluenzaA__ADB89651

SEQ ID NO: 34568 - RNA, 1701 nt, Artificial Sequence
  hemagglutinin__InfluenzaA__ADB89661
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucggaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34569 - RNA, 1701 nt, Artificial Sequence; identical to SEQ ID NO: 34337
  hemagglutinin__InfluenzaA__ADB89671

SEQ ID NO: 34570 - RNA, 1701 nt, Artificial Sequence
  hemagglutinin__InfluenzaA__ADB89681
augaaggcaauacuaguaguucugcuauauacauuugcaaccgcaaaugccgacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34571 - RNA, 1701 nt, Artificial Sequence; identical to SEQ ID NO: 33173
  hemagglutinin__InfluenzaA__ADB89691

SEQ ID NO: 34572 - RNA, 1701 nt, Artificial Sequence
  hemagglutinin__InfluenzaA__ADB89701
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34573 - RNA, 1701 nt, Artificial Sequence
  hemagglutinin__InfluenzaA__ADB89711
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaaggauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34574 - RNA, 1701 nt, Artificial Sequence
  hemagglutinin__InfluenzaA__ADB89721
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacgcuggaguuugacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguaccuuugggggguucaccacccggguacggacaaagaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacaaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 34575 - RNA, 1701 nt, Artificial Sequence
  hemagglutinin__InfluenzaA__ADB90360
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaaacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34576 - RNA, 1701 nt, Artificial Sequence
  hemagglutinin__InfluenzaA__ADB90370
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34577 - RNA, 1701 nt, Artificial Sequence; identical to SEQ ID NO: 34094
  hemagglutinin__InfluenzaA__ADB90414

SEQ ID NO: 34578 - RNA, 1701 nt, Artificial Sequence; identical to SEQ ID NO: 33620
  hemagglutinin__InfluenzaA__ADC32409

SEQ ID NO: 34579 - RNA, 1701 nt, Artificial Sequence
  hemagglutinin__InfluenzaA__ADC32410
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaguauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaaaaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34580 - RNA, 1701 nt, Artificial Sequence
  hemagglutinin__InfluenzaA__ADC32411
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggcaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34581 - RNA, 1701 nt, Artificial Sequence; identical to SEQ ID NO: 34264
  hemagglutinin__InfluenzaA__ADC32412

SEQ ID NO: 34582 - RNA, 1701 nt, Artificial Sequence
  hemagglutinin__InfluenzaA__ADC32413
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34583 - RNA, 1701 nt, Artificial Sequence; identical to SEQ ID NO: 33620
  hemagglutinin__InfluenzaA__ADC32414

SEQ ID NO: 34584 - RNA, 1701 nt, Artificial Sequence; identical to SEQ ID NO: 33620
  hemagglutinin__InfluenzaA__ADC32415

SEQ ID NO: 34585 - RNA, 1701 nt, Artificial Sequence; identical to SEQ ID NO: 33620
  hemagglutinin__InfluenzaA__ADC32416

SEQ ID NO: 34586 - RNA, 1701 nt, Artificial Sequence
  hemagglutinin__InfluenzaA__ADC32417
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaauacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34587 - RNA, 1701 nt, Artificial Sequence; identical to SEQ ID NO: 33620
  hemagglutinin__InfluenzaA__ADC32418

SEQ ID NO: 34588 - RNA, 1701 nt, Artificial Sequence
  hemagglutinin__InfluenzaA__ADC32419
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguucgguuaucaccaucaaaaugaucaggggucagcauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34589 - RNA, 1701 nt, Artificial Sequence
  hemagglutinin__InfluenzaA__ADC32420
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguagaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaacgaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34590 - RNA, 1701 nt, Artificial Sequence; identical to SEQ ID NO: 33620
  hemagglutinin__InfluenzaA__ADC32421

SEQ ID NO: 34591 - RNA, 1701 nt, Artificial Sequence
  hemagglutinin__InfluenzaA__ADC32422
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34592 - RNA, 1701 nt, Artificial Sequence
  hemagglutinin__InfluenzaA__ADC32423
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguuaaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuag

SEQ ID NO: 34593 - RNA, 1701 nt, Artificial Sequence
  hemagglutinin__InfluenzaA__ADC32434
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaggggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34594 - RNA, 1701 nt, Artificial Sequence
  hemagglutinin__InfluenzaA__ADC32435
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34595 - RNA, 1701 nt, Artificial Sequence
  hemagglutinin__InfluenzaA__ADC34940
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccugaggucacuaguugccucaucuggcacacuggaguuuaacaaugaaagauucaauuggacgggagucacucaaaauggaacaagcucugcuugcaaaaggggaucugauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccugcaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcagaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauaggcugaucgggaaaaccaacgagaaauuccaucagauugaaaaagaauucucagaaguagaagggagaauucaggaccucgagaaauauguugaggacacuaaaauagaucucuggucauacaacgcggagcuccuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggcuacaaagauuggauccuauggauuuccuuugccauaucauguuuuuugcuuuguguugcuuuguugggguucaucaugugggccugccaaaaaggcaacauuaggugcaacauuugcauuuaa

SEQ ID NO: 34596 - RNA, 1701 nt, Artificial Sequence; identical to SEQ ID NO: 34508
  hemagglutinin__InfluenzaA__ADC38987

SEQ ID NO: 34597 - RNA, 1701 nt, Artificial Sequence
  hemagglutinin__InfluenzaA__ADC38997
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagacguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 34598 - RNA, 1701 nt, Artificial Sequence
  hemagglutinin__InfluenzaA__ADC39007
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34599 - RNA, 1698 nt, Artificial Sequence
  hemagglutinin__InfluenzaA__ADC45604
augaaagcaaaacuacugguccuguuaugcacauuuacagcuacauaugcagacacaauauguauaggcuaccaugcuaacaacucgaccgacacuguugacacaguacuugaaaagaaugugacagugacgcacucugucaaccugcuugagaacagucacaauggaaaacuaugucuauuaaaaggaauagccccacuacaauuggguaauugcagcguugccgguuggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaagucuuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuaggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34600 - RNA, 1698 nt, Artificial Sequence
  hemagglutinin__InfluenzaA__ADC45626
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacacuguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauagguaaccaaaugacccucuaccauaaagaaaaugcuuaugucucuguagugucuucacauuauagcagaaaauucaccccagaaauagccaaaagacccaaagugagagaucaagaaggaagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34601 - RNA, 1698 nt, Artificial Sequence
  hemagglutinin__InfluenzaA__ADC45637
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuuugccgacuaugaggaacugagggagcaauugaguucaguaucuucauuugagagguucgaaauauuccccaaagaaagcucauggcccaaucacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaagugagagaucaagaaggaagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34602 - RNA, 1698 nt, Artificial Sequence
  hemagglutinin__InfluenzaA__ADC45648
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcauugccgggugggucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34603 - RNA, 1698 nt, Artificial Sequence
  hemagglutinin__InfluenzaA__ADC45659
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaaaaaagcucauggcccaaccacaccguaaccggagugucagcaucaugcucccauaauggagaaagcaguuuuuacagaaauuugcuauggcugacggagaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34604 - RNA, 1698 nt, Artificial Sequence
  hemagglutinin__InfluenzaA__ADC45670
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagggucagcaucaugcucccauaauggagaaagcaguuuuuacagaaauuugcuauggcugacggggaagaaugguuuguacccaaaccugagcaaguccuaugcaaacaacaaagaaaaagaaguccuuguacuaugggguguucaucacccuccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34605 - RNA, 1698 nt, Artificial Sequence
  hemagglutinin__InfluenzaA__ADC45681
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucagcaucuucauuugagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagaaaguccuaugcaaacaacaaggagaaagaaguccucguacuaugggguguucaucacccgccaaacauaggugaccaaaugacccucuaccauaaagaaaaugcuuaugucucuguagugucuucacauuauagcagaaaauucaccccagaaauagccaaaagacccaaagugagagaucaagaaggaagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34606 - RNA, 1698 nt, Artificial Sequence
  hemagglutinin__InfluenzaA__ADC45692
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaagaagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacuaaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaagugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaaugaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34607 - RNA, 1698 nt, Artificial Sequence; identical to SEQ ID NO: 33674
  hemagglutinin__InfluenzaA__ADC45703

SEQ ID NO: 34608 - RNA, 1698 nt, Artificial Sequence
  hemagglutinin__InfluenzaA__ADC45714
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuuugccgacuaugaggaacugagggagcaauugaguucaguaucuucauuugagagguucgaaauauuccccaaagaaagcucauggcccaaucacaccguaaccggaguauccgcaucaugcucccauaauggggaaagcagcuuuuacaaaaauuugcuauggcugacgggaaagaaugguuuguacccaaaccugagcaaguccuaugcaaacaacaaggagaaagaaguccucguacuaugggguguucaucacccgccaaacauaggugaccaaacgacccucuaucauaaagaaaaugcuuaugucucuguagugucuucacauuauagcagaaaauucaccccagaaauagccaaaagacccaaagugagagaucaagaaggaagaaucaacuacuacuggacucugcuugaacccggggauacaauaauauuugaggcaaguggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucagaagugcaaaauuaaggaugguuacaggacuaaggaacaucccauccauucaauccagagguuuguuuggagccauugcugguuucauugaagggggguggacuggaaugguagaugguugguaugguuaucaucaccagaaugagcaaggaucuggcuaugcugcagaucaaaaaagcacacaaaaugccauuaaugggaucacaaacaaagugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugagagaacuuuggauuuccaugacuccaaugugaagaauuuguaugagaaaguaaaaaaccaauuaaaaaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34609 - RNA, 1698 nt, Artificial Sequence
  hemagglutinin__InfluenzaA__ADC45725
augaaaguaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguccuuuuggucucccugggggcaaucagcuucuggauguguuccaaugggucuuugcaguguagaauaugcaucuaa

SEQ ID NO: 34610 - RNA, 1698 nt, Artificial Sequence
  hemagglutinin__InfluenzaA__ADC45736
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugaucuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggagaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaauacuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaauaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34611 - RNA, 1698 nt, Artificial Sequence
  hemagglutinin__InfluenzaA__ADC45747
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaccaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34612 - RNA, 1698 nt, Artificial Sequence
  hemagglutinin__InfluenzaA__ADC45758
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucuuggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuagaaagaaggauggaaaacuugaauaaaaaaguugaugauggauuuauagacauuuggacauauaaugcagaacuguugguucuacuggaaaaugaaaggacuuugaauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34613 - RNA, 1698 nt, Artificial Sequence
  hemagglutinin__InfluenzaA__ADC45780
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacgugcacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucaggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34614 - RNA, 1698 nt, Artificial Sequence
  hemagglutinin__InfluenzaA__ADC45791
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucauggucauacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34615 - RNA, 1698 nt, Artificial Sequence
  hemagglutinin__InfluenzaA__ADC45813
augaaaguaaaacuacugauccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacgaugaagaaugguuuguacccaaaccugagcaaguccuaugcaaacaacaaagaaaaagaaguccuuguacuaugggguguucaucacccgccaaacauaggugaccaaaagacccucuauaacacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcaaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34616 - RNA, 1698 nt, Artificial Sequence
  hemagglutinin__InfluenzaA__ADC45824
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaagagucauggucauacauuguagaaaaaccaaauccugagaauggaacauguuacccagggcauuucgcugacuaugaggaauugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaagacccucuaucguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34617 - RNA, 1698 nt, Artificial Sequence
  hemagglutinin__InfluenzaA__ADC45835
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuguacuaugggguguucaucacccgccaaacauagcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugacauuggaaucaaugggagucuaucagauuuuggcgaucuacucaacagucgccaguucucugguucucuuggucucccugggggcaaucagcuucuggauguguuccaaugggucuuugcaguguagaauaugcaucuaa

SEQ ID NO: 34618 - RNA, 1698 nt, Artificial Sequence; identical to SEQ ID NO: 33009
  hemagglutinin__InfluenzaA__ADC45846

SEQ ID NO: 34619 - RNA, 1701 nt, Artificial Sequence; identical to SEQ ID NO: 34259
  hemagglutinin__InfluenzaA__ADC53558

SEQ ID NO: 34620 - RNA, 1701 nt, Artificial Sequence
  hemagglutinin__InfluenzaA__ADD14087
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaucacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34621 - RNA, 1701 nt, Artificial Sequence
  hemagglutinin__InfluenzaA__ADD14089
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguaucaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34622 - RNA, 1701 nt, Artificial Sequence; identical to SEQ ID NO: 33173
  hemagglutinin__InfluenzaA__ADD14093

SEQ ID NO: 34623 - RNA, 1701 nt, Artificial Sequence
  hemagglutinin__InfluenzaA__ADD14095
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguguuaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34624 - RNA, 1701 nt, Artificial Sequence; identical to SEQ ID NO: 33173
  hemagglutinin__InfluenzaA__ADD14097

SEQ ID NO: 34625 - RNA, 1701 nt, Artificial Sequence
  hemagglutinin__InfluenzaA__ADD14099
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaguuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34626 - RNA, 1701 nt, Artificial Sequence; identical to SEQ ID NO: 33173
  hemagglutinin__InfluenzaA__ADD14101

SEQ ID NO: 34627 - RNA, 1701 nt, Artificial Sequence
  hemagglutinin__InfluenzaA__ADD14103
augaaggcaauacuaguaguucugcuauguacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggacaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34628 - RNA, 1701 nt, Artificial Sequence
  hemagglutinin__InfluenzaA__ADD14111
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaauaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacgagauuacuaacaaaguaaauucuguuauugaaaagaugaauacacaguucacagcgguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34629 - RNA, 1701 nt, Artificial Sequence
  hemagglutinin__InfluenzaA__ADD14115
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34630 - RNA, 1701 nt, Artificial Sequence; identical to SEQ ID NO: 33173
  hemagglutinin__InfluenzaA__ADD14117

SEQ ID NO: 34631 - RNA, 1701 nt, Artificial Sequence
  hemagglutinin__InfluenzaA__ADD14119
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34632 - RNA, 1701 nt, Artificial Sequence; identical to SEQ ID NO: 34631
  hemagglutinin__InfluenzaA__ADD14121

SEQ ID NO: 34633 - RNA, 1701 nt, Artificial Sequence; identical to SEQ ID NO: 34631
  hemagglutinin__InfluenzaA__ADD14123

SEQ ID NO: 34634 - RNA, 1701 nt, Artificial Sequence; identical to SEQ ID NO: 33173
  hemagglutinin__InfluenzaA__ADD14127

SEQ ID NO: 34635 - RNA, 1701 nt, Artificial Sequence
  hemagglutinin__InfluenzaA__ADD14129
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccucauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34636 - RNA, 1701 nt, Artificial Sequence
  hemagglutinin__InfluenzaA__ADD14133
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggauuugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34637 - RNA, 1701 nt, Artificial Sequence
  hemagglutinin__InfluenzaA__ADD14135
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaauucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34638 - RNA, 1701 nt, Artificial Sequence; identical to SEQ ID NO: 34631
  hemagglutinin__InfluenzaA__ADD14137

SEQ ID NO: 34639 - RNA, 1701 nt, Artificial Sequence; identical to SEQ ID NO: 33921
  hemagglutinin__InfluenzaA__ADD14139

SEQ ID NO: 34640 - RNA, 1701 nt, Artificial Sequence; identical to SEQ ID NO: 33173
  hemagglutinin__InfluenzaA__ADD14143

SEQ ID NO: 34641 - RNA, 1701 nt, Artificial Sequence
  hemagglutinin__InfluenzaA__ADD14145
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacaguaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34642 - RNA, 1701 nt, Artificial Sequence; identical to SEQ ID NO: 33173
  hemagglutinin__InfluenzaA__ADD14147

SEQ ID NO: 34643 - RNA, 1701 nt, Artificial Sequence
  hemagglutinin__InfluenzaA__ADD14151
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 34644 - RNA, 1701 nt, Artificial Sequence; identical to SEQ ID NO: 34631
  hemagglutinin__InfluenzaA__ADD14153

SEQ ID NO: 34645 - RNA, 1701 nt, Artificial Sequence
  hemagglutinin__InfluenzaA__ADD14155
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaaggcccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34646 - RNA, 1701 nt, Artificial Sequence
  hemagglutinin__InfluenzaA__ADD14157
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauuaagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34647 - RNA, 1701 nt, Artificial Sequence
  hemagglutinin__InfluenzaA__ADD14162
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34648 - RNA, 1701 nt, Artificial Sequence; identical to SEQ ID NO: 33801
  hemagglutinin__InfluenzaA__ADD14172

SEQ ID NO: 34649 - RNA, 1701 nt, Artificial Sequence
  hemagglutinin__InfluenzaA__ADD14182
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaaugggacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 34650 - RNA, 1701 nt, Artificial Sequence; identical to SEQ ID NO: 34649
  hemagglutinin__InfluenzaA__ADD14192

SEQ ID NO: 34651 - RNA, 1701 nt, Artificial Sequence; identical to SEQ ID NO: 33206
  hemagglutinin__InfluenzaA__ADD14202

SEQ ID NO: 34652 - RNA, 1701 nt, Artificial Sequence
  hemagglutinin__InfluenzaA__ADD21447
augaaggcaauacuaguguucuugcuauauacauuugcgaccgcaaaugcagacacacuauguauagguuaccaugcaaauaauucaacugacacuguugacacaguauuagaaaagaauguaacaguaacacacucuguuaaccuucuagaagacagacauaacggaaaacuauguaaacuaagagggguagcuccauugcauuuggguaaauguaacauugcuggauggcuccugggaaauccagagugugaauuacuauucacagcaagcucauggucuuacauuguggagacaucuaacucagauaaugggacauguuacccaggagauuucaucaauuaugaagagcuaagagagcaauugagcucagugucaucauuugaaagauuugagauguuccccaagucaaguucauggcccaaucaugaaacgaacagaggugugacagcagcauguccuuaugcuggagcaaacagcuucuacagaaauuuaauauggcuuguaaaaaaagaaaauucauacccaaagcuaagcaaauccuauauuaacaauaaggagaaggagguccucgugcuauggggaauucaccauccaccuaccagugcugaccaacaaagucucuaccagaaugcagaugccuauguuuuuguggggucaucaaaauacaacaagaaauucaggccagaaauagcagcaagacccaaggugagaggucaaacagggagaaugaacuacuacuggacacuaguagaaccuggagauacaauaacauucgaagcaacugaaaaucuagugguaccaagauaugccuucgcaaugaaaagagguucuggaucugguauuaucauuucagauacaccaguccacgauugcaacacgacuugucaaacacccaaaggugcuauaaacaccagccuuccauuccagaauauacauccaguuacaauuggagaauguccaaaauaugucaaaagcacaaauuugagaauggcuacaggauuaagaaauaucccgucuauucaaucuagaggccuguuuggagcuauugcuggcuuuauugaagggggauggacaggaaugauagauggaugguacgguuaucaccaucaaaaugagcaaggaucaggauaugcagccgaccgaaagagcacacagaaugccauugacgggaucacuaacaaaguaaauucuguuauugaaaagaugaacacacaauucacagcaguggguaaagaauucaaccaucuggaaaaaagaauagagaauuuaaacaaaaaaguugaugauggucuucuggauguuuggacuuauaaugccgaacuguugguucuauuagaaaaugaaagaacuuuggauuaccaugauucaaaugugaagaaccuauaugagaaaguaagaagccagcuaaaaaacaaugccaaggaaauuggaaauggcugcuuugaauuuuaccacaaaugugaugacacguguauggagagcgucagaaauggagcuuaugauuauccaaaauacucagaagaagcaaaacuaaacagagaggagauagaugggguaaagcuggaaucaacaaggauuuaccaaauuuuggcgaucuacucaacugucgccaguucauugguacuguuagucucccugggggcaaucaguuucuggaugugcuccaaugggucuuuacagugcagaauauguauuuaa

SEQ ID NO: 34653 - RNA, 1701 nt, Artificial Sequence
  hemagglutinin__InfluenzaA__ADD21457
augaaggcaauacuaguguucuugcuauauacauuugcgaccgcaaaugcagacacacuauguauagguuaccaugcaaauaauucaacugacacuguugacacgguauuagaaaagaauguaacaguaacacacucuguuaaccuucuagaagacagacauaacggaaaacuauguaaacuaagagggguagcuccauugcauuuggguaaauguaacauugcuggauggcuccugggaaauccagagugugaauuacuauucacagcaagcucauggucuuacauuguggagacaucuaacucagauaaugggacauguuacccaggagauuucaucaauuaugaagagcuaagagagcaauugagcucagugucaucauuugaaagauuugagauguuccccaagucaaguucauggcccaaucaugaaacgaacagaggugugacagcagcauguccuuaugcuggagcaaacagcuucuacagaaauuuaauauggcuuguaaaaaaagaaaauucauacccaaagcuaagcaaauccuauauuaacaauaaggagaaggagguccucgugcuauggggaauucaccauccaccuaccagugcugaccaacaaagucucuaccagaaugcagaugccuauguuuuuguggggucaucaaaauacaacaagaaauucaggccagaaauagcagcaagacccaaggugagaggucaaacagggagaaugaacuacuacuggacacuaguagaaccuggagauacaauaacauucgaagcaacuggaaaucuagugguaccaagauaugccuucgcaaugaaaagagguucuggaucugguauuaucauuucagauacaccaguccacgauugcaacacgacuugucaaacacccaaaggugcuguaaacaccagccuuccauuccagaauauacauccaguuacaauuggagaauguccaaaauaugucaaaagcacaaauuugagaauggcuacaggauuaagaaauaucccgucuauucaaucuagaggccuguuuggagcuauugcuggcuuuauugaagggggauggacaggaaugauagauggaugguacgguuaucaccaucaaaaugagcaaggaucaggauaugcagccgaccgaaagagcacacagaaugccauugacgggaucacuaacaaaguaaauucuguuauugaaaagaugaacacacaauucacagcaguggguaaagaauucaaccaucuggaaaaaagaauagagaauuuaaacaaaaaaguugaugauggucuucuggauguuuggacuuauaaugccgaacuguugguucuauuagaaaaugaaagaacuuuggauuaccaugauucaaaugugaagaaccuauaugagaaaguaagaagccagcuaaaaaacaaugccaaggaaauuggaaauggcugcuuugaauuuuaccacaaaugugaugacacguguauggagagcgucagaaauggaacuuaugauuauccaaaauacucagaagaagcaaaacuaaacagagaggagauagaugggguaaagcuggaaucaacaaggauuuaccaaauuuuggcgaucuacucaacugucgccaguucauugguacuguuagucucccugggggcaaucaguuucuggaugugcuccaaugggucuuuacagugcagaauauguauuuaa

SEQ ID NO: 34654 - RNA, 1698 nt, Artificial Sequence
  hemagglutinin__InfluenzaA__ADD21467
augaaagcaaaacuacugguccuguuauguacauuuacagcuacauaugcagacacaauauguauaggauaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuaccgaaauuugcuauggcugacggggaagaaugguuuguacccaaaccugaguaaguccuaugcaaacaacaaagagaaagaaguccuuguacuaugggguguucaucacccgccuaacauaagggaccaaagggcccucuaucauacagaaaaugcuuaugucucuguagugucuucacauuauagcagacgauucaccccagaaauagccaaaagacccaaaguaagaggucaggaaggaagaaucaacuacuacuggacucugcuggaacccggggauacaauaauauuugaggcaaauggaaauuuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugccaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 34655 - RNA, 1701 nt, Artificial Sequence
  hemagglutinin__InfluenzaA__ADD21560
augaagacuaucauugcuuuuagccacauuuuaugucugauuuacgcucaaaaacuucccggaagugacaacagcauggcaacgcuaugccugggacaccaugcaguaccaaauggaacguuagugaaaacaaucacggaugaccaaauugaagugacuaaugcuacugagcugguucaaaguuccucaacagguagaauauguaacaguccucaccacauccuugaugggaaaaauugcacacugauagaugcucuauugggagacccucauugugaugacuuccaaaacaaggaaugggaccuuuuuguugaacgaagcacagccuacagcaacugcuacccuuauuaugugccggauuaugccucccuuaggucacuaguugccucauccggcacccuggaauucacccaagaaagcuucaauuggaccggaguuacucaagauggaucaagcuauacuugcagaaggaaaucuguuaacaguuucuuuaguagauuaaauugguugcauaauuuggacuacaaauauccagcgcugaacguaacuaugccaaacaaugacaaauuugacaaauuguacauuugggggguucaccacccggguacggacagggaccaaaccaaccuauauguucaagcaucagggagaguuacagucuccacaaaaagaagccaacaaacuguaaucccgaacaucggaucuagacccuggguaaggggugucuccagcauaauaagcaucuauuggacaauaguaaaaccgggagacauacuuuugauuaacagcacaggaaaucuaauugccccucgggguuacuucaaaauacaaagugggaaaagcucaauaaugagaucagaugcacccauuggcaacugcaauucugaaugcauuacuccaaauggaagcauucccaaugacaaaccuuuucaaaauguaaacaggaucacauauggggccuguccaagauauguuaagcaaaacacucugaaauuggcaacagggaugcggaauguaccagagaaacaaacuagaggcauauucggcgcaaucgcaggcuucauagaaaaugguugggaggggaugguggacgguugguacgguuucaggcaucaaaauucugaaggcacaggacaagcagcagaucuuaaaaguacucaagcagcaaucaaccaaaucaccgggaaacugaauagaguaaucaagaaaacgaacgagaaauuccaucaaaucgaaaaagaauucucagaaguagaagggagaauucaggaccuagagaaauacguugaagacacuaaaauagaucucuggucuuacaacgcggagcuucuuguugcccuggagaaccaacauacaauugauuuaacugacucagaaaugaacaaacuguucgaaagaacaaggaagcaacugcgggaaaaugcugaggacaugggcaaugguugcuucaaaauauaccacaaaugugacaaugccugcauaggaucaaucagaaauggaacuuaugaccaugauguauacagagacgaggcauuaaacaaucgguuccagaucaaaaguguucagcugaagucaggauacaaagauuggauccuauggauuuccuuugccaugucaugcuuuuugcuuuguguuguucugcugggguucauuauguggaccugccaaaaaggcaacauuaagugcaacauuugcauuuga

SEQ ID NO: 34656 - RNA, 1701 nt, Artificial Sequence; identical to SEQ ID NO: 33197
  hemagglutinin__InfluenzaA__ADD21734

SEQ ID NO: 34657 - RNA, 1701 nt, Artificial Sequence; identical to SEQ ID NO: 33173
  hemagglutinin__InfluenzaA__ADD21744

SEQ ID NO: 34658 - RNA, 1701 nt, Artificial Sequence
  hemagglutinin__InfluenzaA__ADD21764
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34659 - RNA, 1701 nt, Artificial Sequence
  hemagglutinin__InfluenzaA__ADD21774
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuguucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34660 - RNA, 1701 nt, Artificial Sequence; identical to SEQ ID NO: 33173
  hemagglutinin__InfluenzaA__ADD21784

SEQ ID NO: 34661 - RNA, 1701 nt, Artificial Sequence; identical to SEQ ID NO: 34557
  hemagglutinin__InfluenzaA__ADD21794

SEQ ID NO: 34662 - RNA, 1701 nt, Artificial Sequence; identical to SEQ ID NO: 33173
  hemagglutinin__InfluenzaA__ADD21804

SEQ ID NO: 34663 - RNA, 1701 nt, Artificial Sequence
  hemagglutinin__InfluenzaA__ADD21814
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuagcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaaugucccaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34664 - RNA, 1701 nt, Artificial Sequence
  hemagglutinin__InfluenzaA__ADD21824
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacgcccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34665 - RNA, 1701 nt, Artificial Sequence
  hemagglutinin__InfluenzaA__ADD21834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacgcccaagggugcuauaaacaccagccucccauuucagaauauacauccgaucacaauuggaaaauguccaaaauauguaaaaaguacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34666 - RNA, 1701 nt, Artificial Sequence
  hemagglutinin__InfluenzaA__ADD21844
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34667 - RNA, 1701 nt, Artificial Sequence; identical to SEQ ID NO: 34337
  hemagglutinin__InfluenzaA__ADD21854

SEQ ID NO: 34668 - RNA, 1701 nt, Artificial Sequence
  hemagglutinin__InfluenzaA__ADD21864
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34669 - RNA, 1701 nt, Artificial Sequence
  hemagglutinin__InfluenzaA__ADD21884
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcaugggaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34670 - RNA, 1701 nt, Artificial Sequence; identical to SEQ ID NO: 34572
  hemagglutinin__InfluenzaA__ADD21894

SEQ ID NO: 34671 - RNA, 1701 nt, Artificial Sequence
  hemagglutinin__InfluenzaA__ADD22501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaacugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaauccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34672 - RNA, 1701 nt, Artificial Sequence; identical to SEQ ID NO: 34572
  hemagglutinin__InfluenzaA__ADD22511

SEQ ID NO: 34673 - RNA, 1701 nt, Artificial Sequence
  hemagglutinin__InfluenzaA__ADD22521
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34674 - RNA, 1701 nt, Artificial Sequence; identical to SEQ ID NO: 33173
  hemagglutinin__InfluenzaA__ADD22531

SEQ ID NO: 34675 - RNA, 1701 nt, Artificial Sequence
  hemagglutinin__InfluenzaA__ADD22541
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuagccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguggguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34676 - RNA, 1701 nt, Artificial Sequence; identical to SEQ ID NO: 34572
  hemagglutinin__InfluenzaA__ADD22554

SEQ ID NO: 34677 - RNA, 1701 nt, Artificial Sequence; identical to SEQ ID NO: 34572
  hemagglutinin__InfluenzaA__ADD22564

SEQ ID NO: 34678 - RNA, 1701 nt, Artificial Sequence
  hemagglutinin__InfluenzaA__ADD22574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34679 - RNA, 1701 nt, Artificial Sequence
  hemagglutinin__InfluenzaA__ADD22584
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34680 - RNA, 1701 nt, Artificial Sequence
  hemagglutinin__InfluenzaA__ADD22594
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34681 - RNA, 1701 nt, Artificial Sequence; identical to SEQ ID NO: 34572
  hemagglutinin__InfluenzaA__ADD22604

SEQ ID NO: 34682 - RNA, 1701 nt, Artificial Sequence; identical to SEQ ID NO: 34572
  hemagglutinin__InfluenzaA__ADD22614

SEQ ID NO: 34683 - RNA, 1701 nt, Artificial Sequence; identical to SEQ ID NO: 34572
  hemagglutinin__InfluenzaA__ADD22624

SEQ ID NO: 34684 - RNA, 1701 nt, Artificial Sequence
  hemagglutinin__InfluenzaA__ADD22634
augaaggcaauacuaguaguucugcuauguacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34685 - RNA, 1701 nt, Artificial Sequence
  hemagglutinin__InfluenzaA__ADD22645
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuagaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaagggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34686 - RNA, 1701 nt, Artificial Sequence
  hemagglutinin__InfluenzaA__ADD22665
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaaaggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuagccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34687 - RNA, 1701 nt, Artificial Sequence
  hemagglutinin__InfluenzaA__ADD22675
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggccuaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34688 - RNA, 1701 nt, Artificial Sequence
  hemagglutinin__InfluenzaA__ADD22685
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34689 - RNA, 1701 nt, Artificial Sequence; identical to SEQ ID NO: 34679
  hemagglutinin__InfluenzaA__ADD22695

SEQ ID NO: 34690 - RNA, 1701 nt, Artificial Sequence
  hemagglutinin__InfluenzaA__ADD22722
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaggcauaacgggaaacuauguaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaguuacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34691 - RNA, 1701 nt, Artificial Sequence; identical to SEQ ID NO: 34673
  hemagglutinin__InfluenzaA__ADD22732

SEQ ID NO: 34692 - RNA, 1701 nt, Artificial Sequence
  hemagglutinin__InfluenzaA__ADD22742
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaguuacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugcuaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34693 - RNA, 1701 nt, Artificial Sequence; identical to SEQ ID NO: 33173
  hemagglutinin__InfluenzaA__ADD22752

SEQ ID NO: 34694 - RNA, 1701 nt, Artificial Sequence; identical to SEQ ID NO: 33264
  hemagglutinin__InfluenzaA__ADD22762

SEQ ID NO: 34695 - RNA, 1701 nt, Artificial Sequence; identical to SEQ ID NO: 34572
  hemagglutinin__InfluenzaA__ADD22772

SEQ ID NO: 34696 - RNA, 1701 nt, Artificial Sequence; identical to SEQ ID NO: 34679
  hemagglutinin__InfluenzaA__ADD22782

SEQ ID NO: 34697 - RNA, 1701 nt, Artificial Sequence
  hemagglutinin__InfluenzaA__ADD22792
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34698 - RNA, 1701 nt, Artificial Sequence
  hemagglutinin__InfluenzaA__ADD22802
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34699 - RNA, 1701 nt, Artificial Sequence; identical to SEQ ID NO: 34572
  hemagglutinin__InfluenzaA__ADD22812

SEQ ID NO: 34700 - RNA, 1701 nt, Artificial Sequence
  hemagglutinin__InfluenzaA__ADD22822
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuagugcagacaauggaacguguuacccaggagauuucaucgauuaugaggagcuaagagagcaacugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34701 - RNA, 1701 nt, Artificial Sequence; identical to SEQ ID NO: 34572
  hemagglutinin__InfluenzaA__ADD22832

SEQ ID NO: 34702 - RNA, 1701 nt, Artificial Sequence
  hemagglutinin__InfluenzaA__ADD22842
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccaggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34703 - RNA, 1701 nt, Artificial Sequence
  hemagglutinin__InfluenzaA__ADD22852
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34704 - RNA, 1701 nt, Artificial Sequence
  hemagglutinin__InfluenzaA__ADD22941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaucucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34705 - RNA, 1701 nt, Artificial Sequence
  hemagglutinin__InfluenzaA__ADD22951
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaaacucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34706 - RNA, 1701 nt, Artificial Sequence; identical to SEQ ID NO: 34572
  hemagglutinin__InfluenzaA__ADD22961

SEQ ID NO: 34707 - RNA, 1701 nt, Artificial Sequence; identical to SEQ ID NO: 34572
  hemagglutinin__InfluenzaA__ADD22971

SEQ ID NO: 34708 - RNA, 1701 nt, Artificial Sequence; identical to SEQ ID NO: 34572
  hemagglutinin__InfluenzaA__ADD23072

SEQ ID NO: 34709 - RNA, 1701 nt, Artificial Sequence
  hemagglutinin__InfluenzaA__ADD23082
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34710 - RNA, 1701 nt, Artificial Sequence
  hemagglutinin__InfluenzaA__ADD23102
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaaaguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugagaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34711 - RNA, 1701 nt, Artificial Sequence; identical to SEQ ID NO: 34572
  hemagglutinin__InfluenzaA__ADD23112

SEQ ID NO: 34712 - RNA, 1701 nt, Artificial Sequence; identical to SEQ ID NO: 34572
  hemagglutinin__InfluenzaA__ADD23122

SEQ ID NO: 34713 - RNA, 1701 nt, Artificial Sequence; identical to SEQ ID NO: 33173
  hemagglutinin__InfluenzaA__ADD23132

SEQ ID NO: 34714 - RNA, 1701 nt, Artificial Sequence
  hemagglutinin__InfluenzaA__ADD23142
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuauaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34715 - RNA, 1701 nt, Artificial Sequence
  hemagglutinin__InfluenzaA__ADD23162
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuauaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaggucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34716 - RNA, 1701 nt, Artificial Sequence; identical to SEQ ID NO: 34714
  hemagglutinin__InfluenzaA__ADD23172

SEQ ID NO: 34717 - RNA, 1701 nt, Artificial Sequence; identical to SEQ ID NO: 34714
  hemagglutinin__InfluenzaA__ADD23182

SEQ ID NO: 34718 - RNA, 1701 nt, Artificial Sequence
  hemagglutinin__InfluenzaA__ADD23192
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuauaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34719 - RNA, 1701 nt, Artificial Sequence; identical to SEQ ID NO: 34714
  hemagglutinin__InfluenzaA__ADD23202

SEQ ID NO: 34720 - RNA, 1701 nt, Artificial Sequence
  hemagglutinin__InfluenzaA__ADD23220
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34721 - RNA, 1701 nt, Artificial Sequence; identical to SEQ ID NO: 34557
  hemagglutinin__InfluenzaA__ADD23230

SEQ ID NO: 34722 - RNA, 1701 nt, Artificial Sequence; identical to SEQ ID NO: 34337
  hemagglutinin__InfluenzaA__ADD23240

SEQ ID NO: 34723 - RNA, 1701 nt, Artificial Sequence
  hemagglutinin__InfluenzaA__ADD23260
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34724 - RNA, 1701 nt, Artificial Sequence
  hemagglutinin__InfluenzaA__ADD23280
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcgaguucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34725 - RNA, 1701 nt, Artificial Sequence
  hemagglutinin__InfluenzaA__ADD23290
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34726 - RNA, 1701 nt, Artificial Sequence
  hemagglutinin__InfluenzaA__ADD23300
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaagcuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggggacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34727 - RNA, 1701 nt, Artificial Sequence
  hemagglutinin__InfluenzaA__ADD23310
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34728 - RNA, 1701 nt, Artificial Sequence
  hemagglutinin__InfluenzaA__ADD23320
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34729 - RNA, 1701 nt, Artificial Sequence
  hemagglutinin__InfluenzaA__ADD23330
augaaggcaauacuaguaguucuguuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34730 - RNA, 1701 nt, Artificial Sequence
  hemagglutinin__InfluenzaA__ADD23355
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaauguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34731 - RNA, 1701 nt, Artificial Sequence
  hemagglutinin__InfluenzaA__ADD23375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34732 - RNA, 1701 nt, Artificial Sequence
  hemagglutinin__InfluenzaA__ADD23385
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucucugggggcaaucaguuucuggaugugcucuaaugggucucuacaguguagaauauguauuuaa

SEQ ID NO: 34733 - RNA, 1701 nt, Artificial Sequence
  hemagglutinin__InfluenzaA__ADD23405
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaguuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34734 - RNA, 1701 nt, Artificial Sequence
  hemagglutinin__InfluenzaA__ADD23415
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugaaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34735 - RNA, 1701 nt, Artificial Sequence
  hemagglutinin__InfluenzaA__ADD23435
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34736 - RNA, 1701 nt, Artificial Sequence
  hemagglutinin__InfluenzaA__ADD23465
augaaggcaauacuagcaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34737 - RNA, 1701 nt, Artificial Sequence; identical to SEQ ID NO: 34337
  hemagglutinin__InfluenzaA__ADD23475

SEQ ID NO: 34738 - RNA, 1701 nt, Artificial Sequence; identical to SEQ ID NO: 34714
  hemagglutinin__InfluenzaA__ADD23485

SEQ ID NO: 34739 - RNA, 1701 nt, Artificial Sequence
  hemagglutinin__InfluenzaA__ADD23495
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaagaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34740 - RNA, 1701 nt, Artificial Sequence
  hemagglutinin__InfluenzaA__ADD23505
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34741 - RNA, 1701 nt, Artificial Sequence
  hemagglutinin__InfluenzaA__ADD23515
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34742 - RNA, 1701 nt, Artificial Sequence; identical to SEQ ID NO: 34337
  hemagglutinin__InfluenzaA__ADD23994

SEQ ID NO: 34743 - RNA, 1701 nt, Artificial Sequence
  hemagglutinin__InfluenzaA__ADD24004
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34744 - RNA, 1701 nt, Artificial Sequence; identical to SEQ ID NO: 34572
  hemagglutinin__InfluenzaA__ADD24014

SEQ ID NO: 34745 - RNA, 1701 nt, Artificial Sequence
  hemagglutinin__InfluenzaA__ADD52537
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacggaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34746 - RNA, 1701 nt, Artificial Sequence
  hemagglutinin__InfluenzaA__ADD64203
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34747 - RNA, 1701 nt, Artificial Sequence
  hemagglutinin__InfluenzaA__ADD64204
augaaggcaauacuaguaguucugcuauauacauuugcaaccgcaaaugcagacacauuauguauagguuaccaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaauagagccgggagaaaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccagggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34748 - RNA, 1701 nt, Artificial Sequence
  hemagglutinin__InfluenzaA__ADD64205
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34749 - RNA, 1701 nt, Artificial Sequence; identical to SEQ ID NO: 34748
  hemagglutinin__InfluenzaA__ADD64206

SEQ ID NO: 34750 - RNA, 1701 nt, Artificial Sequence; identical to SEQ ID NO: 33971
  hemagglutinin__InfluenzaA__ADD64207

SEQ ID NO: 34751 - RNA, 1701 nt, Artificial Sequence
  hemagglutinin__InfluenzaA__ADD64208
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauccaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34752 - RNA, 1701 nt, Artificial Sequence
  hemagglutinin__InfluenzaA__ADD64209
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34753 - RNA, 1701 nt, Artificial Sequence
  hemagglutinin__InfluenzaA__ADD64210
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 34754 - RNA, 1701 nt, Artificial Sequence
  hemagglutinin__InfluenzaA__ADD64211
augaaggcaauacuaguaguucugcuauauacauuugcaaccgcaaaugcagacacauuauguauagguuaucaugcgaacaauucaacggacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34755 - RNA, 1701 nt, Artificial Sequence
  hemagglutinin__InfluenzaA__ADD64212
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34756 - RNA, 1701 nt, Artificial Sequence
  hemagglutinin__InfluenzaA__ADD64213
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaauggaacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34757 - RNA, 1701 nt, Artificial Sequence
  hemagglutinin__InfluenzaA__ADD64214
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaaacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34758 - RNA, 1701 nt, Artificial Sequence
  hemagglutinin__InfluenzaA__ADD64215
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauagauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34759 - RNA, 1701 nt, Artificial Sequence; identical to SEQ ID NO: 33971
  hemagglutinin__InfluenzaA__ADD64216

SEQ ID NO: 34760 - RNA, 1701 nt, Artificial Sequence
  hemagglutinin__InfluenzaA__ADD64217
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugcugguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34761 - RNA, 1701 nt, Artificial Sequence
  hemagglutinin__InfluenzaA__ADD74350
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34762 - RNA, 1701 nt, Artificial Sequence
  hemagglutinin__InfluenzaA__ADD74360
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaaggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34763 - RNA, 1701 nt, Artificial Sequence; identical to SEQ ID NO: 33173
  hemagglutinin__InfluenzaA__ADD74370

SEQ ID NO: 34764 - RNA, 1701 nt, Artificial Sequence; identical to SEQ ID NO: 34325
  hemagglutinin__InfluenzaA__ADD74398

SEQ ID NO: 34765 - RNA, 1701 nt, Artificial Sequence
  hemagglutinin__InfluenzaA__ADD74428
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34766 - RNA, 1701 nt, Artificial Sequence
  hemagglutinin__InfluenzaA__ADD74438
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaccaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34767 - RNA, 1701 nt, Artificial Sequence; identical to SEQ ID NO: 34325
  hemagglutinin__InfluenzaA__ADD74448

SEQ ID NO: 34768 - RNA, 1701 nt, Artificial Sequence
  hemagglutinin__InfluenzaA__ADD74458
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34769 - RNA, 1701 nt, Artificial Sequence
  hemagglutinin__InfluenzaA__ADD74468
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauaacaauaagacccaaagugagggaucaagaagggagaaugaacuauuacuggacauuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34770 - RNA, 1701 nt, Artificial Sequence
  hemagglutinin__InfluenzaA__ADD74488
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34771 - RNA, 1701 nt, Artificial Sequence; identical to SEQ ID NO: 34325
  hemagglutinin__InfluenzaA__ADD74498

SEQ ID NO: 34772 - RNA, 1701 nt, Artificial Sequence
  hemagglutinin__InfluenzaA__ADD74508
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcugaagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacucaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34773 - RNA, 1701 nt, Artificial Sequence
  hemagglutinin__InfluenzaA__ADD74518
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34774 - RNA, 1701 nt, Artificial Sequence
  hemagglutinin__InfluenzaA__ADD74528
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggugauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguuccagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34775 - RNA, 1701 nt, Artificial Sequence
  hemagglutinin__InfluenzaA__ADD74538
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcagacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucuacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 34776 - RNA, 1701 nt, Artificial Sequence; identical to SEQ ID NO: 34770
  hemagglutinin__InfluenzaA__ADD74548

SEQ ID NO: 34777 - RNA, 1701 nt, Artificial Sequence
  hemagglutinin__InfluenzaA__ADD74558
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaguuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34778 - RNA, 1701 nt, Artificial Sequence
  hemagglutinin__InfluenzaA__ADD74568
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34779 - RNA, 1701 nt, Artificial Sequence
  hemagglutinin__InfluenzaA__ADD74578
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacaucaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34780 - RNA, 1701 nt, Artificial Sequence
  hemagglutinin__InfluenzaA__ADD74588
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugauggccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaguacucaaaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34781 - RNA, 1701 nt, Artificial Sequence
  hemagglutinin__InfluenzaA__ADD74598
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauauagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34782 - RNA, 1701 nt, Artificial Sequence; identical to SEQ ID NO: 34731
  hemagglutinin__InfluenzaA__ADD74608

SEQ ID NO: 34783 - RNA, 1701 nt, Artificial Sequence; identical to SEQ ID NO: 34337
  hemagglutinin__InfluenzaA__ADD74618

SEQ ID NO: 34784 - RNA, 1701 nt, Artificial Sequence
  hemagglutinin__InfluenzaA__ADD74628
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34785 - RNA, 1701 nt, Artificial Sequence
  hemagglutinin__InfluenzaA__ADD74648
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuagaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34786 - RNA, 1701 nt, Artificial Sequence
  hemagglutinin__InfluenzaA__ADD74658
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugcaaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34787 - RNA, 1701 nt, Artificial Sequence; identical to SEQ ID NO: 34731
  hemagglutinin__InfluenzaA__ADD74668

SEQ ID NO: 34788 - RNA, 1701 nt, Artificial Sequence
  hemagglutinin__InfluenzaA__ADD74678
augaaagcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucguugguacugguagucucccugggggcaaucaguuucuggaugugcucuaaugggucucuacaguguagaauauguauuuaa

SEQ ID NO: 34789 - RNA, 1701 nt, Artificial Sequence
  hemagglutinin__InfluenzaA__ADD74688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucacugguacugguagucucccugggggcaaucaguuucuggaugugcucuaaugggucucuacaguguagaauauguauuuaa

SEQ ID NO: 34790 - RNA, 1701 nt, Artificial Sequence
  hemagglutinin__InfluenzaA__ADD74698
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34791 - RNA, 1701 nt, Artificial Sequence; identical to SEQ ID NO: 34731
  hemagglutinin__InfluenzaA__ADD74708

SEQ ID NO: 34792 - RNA, 1701 nt, Artificial Sequence
  hemagglutinin__InfluenzaA__ADD74728
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauaaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucagugguacugguagucucccugggggcaaucaguuucuggaugugcucuaaugggucucuacaguguagaauauguauuuaa

SEQ ID NO: 34793 - RNA, 1701 nt, Artificial Sequence
  hemagglutinin__InfluenzaA__ADD74738
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagaucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaggauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34794 - RNA, 1701 nt, Artificial Sequence; identical to SEQ ID NO: 34337
  hemagglutinin__InfluenzaA__ADD74748

SEQ ID NO: 34795 - RNA, 1701 nt, Artificial Sequence
  hemagglutinin__InfluenzaA__ADD74758
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauaaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34796 - RNA, 1701 nt, Artificial Sequence
  hemagglutinin__InfluenzaA__ADD74768
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugagcuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34797 - RNA, 1701 nt, Artificial Sequence
  hemagglutinin__InfluenzaA__ADD74778
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34798 - RNA, 1701 nt, Artificial Sequence
  hemagglutinin__InfluenzaA__ADD74788
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34799 - RNA, 1701 nt, Artificial Sequence
  hemagglutinin__InfluenzaA__ADD74798
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaauaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34800 - RNA, 1701 nt, Artificial Sequence
  hemagglutinin__InfluenzaA__ADD74808
augaaggcaauacuaguaguucugcuauauacauuugcaaccgcaaaugcagacacauuauguauagguuaucaugcgaacaauucaacagacacuguagacacaguacuagaaaagaauguaacagugacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 34801 - RNA, 1701 nt, Artificial Sequence
  hemagglutinin__InfluenzaA__ADD74818
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34802 - RNA, 1701 nt, Artificial Sequence
  hemagglutinin__InfluenzaA__ADD74838
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuaggggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34803 - RNA, 1701 nt, Artificial Sequence
  hemagglutinin__InfluenzaA__ADD74848
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuga

SEQ ID NO: 34804 - RNA, 1701 nt, Artificial Sequence
  hemagglutinin__InfluenzaA__ADD74858
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggaacaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34805 - RNA, 1701 nt, Artificial Sequence
  hemagglutinin__InfluenzaA__ADD74868
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34806 - RNA, 1701 nt, Artificial Sequence
  hemagglutinin__InfluenzaA__ADD74878
augaaggcaauacuaguaguucugcuauauacauuugcaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgacugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34807 - RNA, 1701 nt, Artificial Sequence
  hemagglutinin__InfluenzaA__ADD74888
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34808 - RNA, 1701 nt, Artificial Sequence
  hemagglutinin__InfluenzaA__ADD74898
augaaggcaauacuaguaguucugcuauauacauuuacaaccgcaaaugcagacacauuauguauagguuaucaugcgaacaauucaacagacacuguagauacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34809 - RNA, 1701 nt, Artificial Sequence
  hemagglutinin__InfluenzaA__ADD74908
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauuccuacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaggcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34810 - RNA, 1701 nt, Artificial Sequence
  hemagglutinin__InfluenzaA__ADD74918
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacgguugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 34811 - RNA, 1701 nt, Artificial Sequence
  hemagglutinin__InfluenzaA__ADD74928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggugauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34812 - RNA, 1701 nt, Artificial Sequence; identical to SEQ ID NO: 34810
  hemagglutinin__InfluenzaA__ADD74938

SEQ ID NO: 34813 - RNA, 1701 nt, Artificial Sequence
  hemagglutinin__InfluenzaA__ADD74958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaaacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34814 - RNA, 1701 nt, Artificial Sequence; identical to SEQ ID NO: 34718
  hemagglutinin__InfluenzaA__ADD74968

SEQ ID NO: 34815 - RNA, 1701 nt, Artificial Sequence
  hemagglutinin__InfluenzaA__ADD74998
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuauaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcgggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34816 - RNA, 1701 nt, Artificial Sequence; identical to SEQ ID NO: 34714
  hemagglutinin__InfluenzaA__ADD75008

SEQ ID NO: 34817 - RNA, 1701 nt, Artificial Sequence; identical to SEQ ID NO: 34337
  hemagglutinin__InfluenzaA__ADD75018

SEQ ID NO: 34818 - RNA, 1701 nt, Artificial Sequence
  hemagglutinin__InfluenzaA__ADD75028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34819 - RNA, 1701 nt, Artificial Sequence
  hemagglutinin__InfluenzaA__ADD75058
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34820 - RNA, 1701 nt, Artificial Sequence
  hemagglutinin__InfluenzaA__ADD75088
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34821 - RNA, 1701 nt, Artificial Sequence; identical to SEQ ID NO: 33206
  hemagglutinin__InfluenzaA__ADD75098

SEQ ID NO: 34822 - RNA, 1701 nt, Artificial Sequence
  hemagglutinin__InfluenzaA__ADD75108
augaaggcaauacuaguaguucugcuauauacguuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34823 - RNA, 1701 nt, Artificial Sequence
  hemagglutinin__InfluenzaA__ADD75118
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34824 - RNA, 1701 nt, Artificial Sequence
  hemagglutinin__InfluenzaA__ADD75128
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34825 - RNA, 1701 nt, Artificial Sequence; identical to SEQ ID NO: 33206
  hemagglutinin__InfluenzaA__ADD75138

SEQ ID NO: 34826 - RNA, 1701 nt, Artificial Sequence; identical to SEQ ID NO: 34337
  hemagglutinin__InfluenzaA__ADD75148

SEQ ID NO: 34827 - RNA, 1701 nt, Artificial Sequence; identical to SEQ ID NO: 33922
  hemagglutinin__InfluenzaA__ADD75158

SEQ ID NO: 34828 - RNA, 1701 nt, Artificial Sequence
  hemagglutinin__InfluenzaA__ADD84494
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgguugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34829 - RNA, 1701 nt, Artificial Sequence
  hemagglutinin__InfluenzaA__ADD84495
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34830 - RNA, 1701 nt, Artificial Sequence
  hemagglutinin__InfluenzaA__ADD84496
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34831 - RNA, 1701 nt, Artificial Sequence; identical to SEQ ID NO: 34829
  hemagglutinin__InfluenzaA__ADD84497

SEQ ID NO: 34832 - RNA, 1701 nt, Artificial Sequence
  hemagglutinin__InfluenzaA__ADD84498
augaaggcaauacuaguaguucugcuauauacauuugcaaccgcaaaugcagacacauuauguauagguuaucaugcgaacaauucaacagacacuguagucacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34833 - RNA, 1701 nt, Artificial Sequence
  hemagglutinin__InfluenzaA__ADD84499
augaaggcaauacuaguaguucugcuauauacauuugcaaccgcaaaugcagacacauuauguauagguuaucaugcuaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagauaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34834 - RNA, 1701 nt, Artificial Sequence
  hemagglutinin__InfluenzaA__ADD92535
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacagaguaaauucuguuauugaaaagaugaauacacaguucacagcaguagguaaagaguucaaccaccuggaaaaaagaauagagaauuuaaauaaaaaaguugauggugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34835 - RNA, 1701 nt, Artificial Sequence; identical to SEQ ID NO: 34761
  hemagglutinin__InfluenzaA__ADD96766

SEQ ID NO: 34836 - RNA, 1701 nt, Artificial Sequence
  hemagglutinin__InfluenzaA__ADD96776
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34837 - RNA, 1701 nt, Artificial Sequence; identical to SEQ ID NO: 33390
  hemagglutinin__InfluenzaA__ADD96786

SEQ ID NO: 34838 - RNA, 1701 nt, Artificial Sequence; identical to SEQ ID NO: 34658
  hemagglutinin__InfluenzaA__ADD96796

SEQ ID NO: 34839 - RNA, 1701 nt, Artificial Sequence
  hemagglutinin__InfluenzaA__ADD96806
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauugggaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34840 - RNA, 1701 nt, Artificial Sequence; identical to SEQ ID NO: 34337
  hemagglutinin__InfluenzaA__ADD96816

SEQ ID NO: 34841 - RNA, 1701 nt, Artificial Sequence
  hemagglutinin__InfluenzaA__ADD96826
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugauggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucgcagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34842 - RNA, 1701 nt, Artificial Sequence; identical to SEQ ID NO: 34363
  hemagglutinin__InfluenzaA__ADD96836

SEQ ID NO: 34843 - RNA, 1701 nt, Artificial Sequence; identical to SEQ ID NO: 34325
  hemagglutinin__InfluenzaA__ADD96846

SEQ ID NO: 34844 - RNA, 1701 nt, Artificial Sequence; identical to SEQ ID NO: 34731
  hemagglutinin__InfluenzaA__ADD96856

SEQ ID NO: 34845 - RNA, 1701 nt, Artificial Sequence
  hemagglutinin__InfluenzaA__ADD96886
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcagaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34846 - RNA, 1701 nt, Artificial Sequence
  hemagglutinin__InfluenzaA__ADD96896
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 34847 - RNA, 1701 nt, Artificial Sequence
  hemagglutinin__InfluenzaA__ADD96906
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauaaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggcuauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34848 - RNA, 1701 nt, Artificial Sequence; identical to SEQ ID NO: 34795
  hemagglutinin__InfluenzaA__ADD96916

SEQ ID NO: 34849 - RNA, 1701 nt, Artificial Sequence; identical to SEQ ID NO: 34714
  hemagglutinin__InfluenzaA__ADD96926

SEQ ID NO: 34850 - RNA, 1701 nt, Artificial Sequence
  hemagglutinin__InfluenzaA__ADD96936
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34851 - RNA, 1701 nt, Artificial Sequence
  hemagglutinin__InfluenzaA__ADD96946
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucaguaucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaagaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34852 - RNA, 1701 nt, Artificial Sequence
  hemagglutinin__InfluenzaA__ADD96956
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34853 - RNA, 1701 nt, Artificial Sequence; identical to SEQ ID NO: 33922
  hemagglutinin__InfluenzaA__ADD96976

SEQ ID NO: 34854 - RNA, 1701 nt, Artificial Sequence; identical to SEQ ID NO: 33922
  hemagglutinin__InfluenzaA__ADD96986

SEQ ID NO: 34855 - RNA, 1701 nt, Artificial Sequence
  hemagglutinin__InfluenzaA__ADD97035
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgauuacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34856 - RNA, 1701 nt, Artificial Sequence
  hemagglutinin__InfluenzaA__ADD97045
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaccgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34857 - RNA, 1701 nt, Artificial Sequence; identical to SEQ ID NO: 34856
  hemagglutinin__InfluenzaA__ADD97055

SEQ ID NO: 34858 - RNA, 1701 nt, Artificial Sequence; identical to SEQ ID NO: 34856
  hemagglutinin__InfluenzaA__ADD97123

SEQ ID NO: 34859 - RNA, 1701 nt, Artificial Sequence
  hemagglutinin__InfluenzaA__ADD97161
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccacugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaaaucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34860 - RNA, 1701 nt, Artificial Sequence
  hemagglutinin__InfluenzaA__ADD97171
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcagucaguuucuggaugugcucuaaugggucucuacaguguagaauauguauuuaa

SEQ ID NO: 34861 - RNA, 1701 nt, Artificial Sequence
  hemagglutinin__InfluenzaA__ADD97181
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcugagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34862 - RNA, 1701 nt, Artificial Sequence; identical to SEQ ID NO: 33922
  hemagglutinin__InfluenzaA__ADD97201

SEQ ID NO: 34863 - RNA, 1701 nt, Artificial Sequence
  hemagglutinin__InfluenzaA__ADD97211
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaccgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34864 - RNA, 1701 nt, Artificial Sequence; identical to SEQ ID NO: 33206
  hemagglutinin__InfluenzaA__ADD97231

SEQ ID NO: 34865 - RNA, 1701 nt, Artificial Sequence
  hemagglutinin__InfluenzaA__ADD97241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaccgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34866 - RNA, 1701 nt, Artificial Sequence; identical to SEQ ID NO: 34856
  hemagglutinin__InfluenzaA__ADD97251

SEQ ID NO: 34867 - RNA, 1701 nt, Artificial Sequence; identical to SEQ ID NO: 34861
  hemagglutinin__InfluenzaA__ADD97261

SEQ ID NO: 34868 - RNA, 1701 nt, Artificial Sequence
  hemagglutinin__InfluenzaA__ADD97271
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcggccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34869 - RNA, 1701 nt, Artificial Sequence; identical to SEQ ID NO: 34860
  hemagglutinin__InfluenzaA__ADD97281

SEQ ID NO: 34870 - RNA, 1701 nt, Artificial Sequence
  hemagglutinin__InfluenzaA__ADD97291
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34871 - RNA, 1701 nt, Artificial Sequence
  hemagglutinin__InfluenzaA__ADD97311
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuauugcugaccaacaaagucucuaucagaaugcagaugcauauguuuuuguggggacaucaagauacagcaagaaguucaagccggaaauagcaauaagacccaaagugagggaucaagaagggagaaugaaauauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacauccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34872 - RNA, 1701 nt, Artificial Sequence
  hemagglutinin__InfluenzaA__ADD97321
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaccgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggcuuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34873 - RNA, 1701 nt, Artificial Sequence; identical to SEQ ID NO: 34337
  hemagglutinin__InfluenzaA__ADD97331

SEQ ID NO: 34874 - RNA, 1701 nt, Artificial Sequence
  hemagglutinin__InfluenzaA__ADD97341
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34875 - RNA, 1701 nt, Artificial Sequence
  hemagglutinin__InfluenzaA__ADD97351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34876 - RNA, 1701 nt, Artificial Sequence
  hemagglutinin__InfluenzaA__ADD97361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34877 - RNA, 1701 nt, Artificial Sequence
  hemagglutinin__InfluenzaA__ADD97371
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguaugcauuuaa

SEQ ID NO: 34878 - RNA, 1701 nt, Artificial Sequence
  hemagglutinin__InfluenzaA__ADD97381
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34879 - RNA, 1701 nt, Artificial Sequence
  hemagglutinin__InfluenzaA__ADD97391
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggccuaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 34880 - RNA, 1701 nt, Artificial Sequence
  hemagglutinin__InfluenzaA__ADD97411
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34881 - RNA, 1701 nt, Artificial Sequence; identical to SEQ ID NO: 34880
  hemagglutinin__InfluenzaA__ADD97421

SEQ ID NO: 34882 - RNA, 1701 nt, Artificial Sequence
  hemagglutinin__InfluenzaA__ADD97431
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34883 - RNA, 1701 nt, Artificial Sequence
  hemagglutinin__InfluenzaA__ADD97441
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34884 - RNA, 1701 nt, Artificial Sequence
  hemagglutinin__InfluenzaA__ADD97451
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacugguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguaugcauuuaa

SEQ ID NO: 34885 - RNA, 1701 nt, Artificial Sequence; identical to SEQ ID NO: 34877
  hemagglutinin__InfluenzaA__ADD97461

SEQ ID NO: 34886 - RNA, 1701 nt, Artificial Sequence; identical to SEQ ID NO: 34778
  hemagglutinin__InfluenzaA__ADD97471

SEQ ID NO: 34887 - RNA, 1701 nt, Artificial Sequence
  hemagglutinin__InfluenzaA__ADD97481
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34888 - RNA, 1701 nt, Artificial Sequence
  hemagglutinin__InfluenzaA__ADD97491
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggaagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacacaagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaauucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34889 - RNA, 1701 nt, Artificial Sequence
  hemagglutinin__InfluenzaA__ADD97501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggaagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacacaagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34890 - RNA, 1701 nt, Artificial Sequence; identical to SEQ ID NO: 34264
  hemagglutinin__InfluenzaA__ADD97511

SEQ ID NO: 34891 - RNA, 1701 nt, Artificial Sequence
  hemagglutinin__InfluenzaA__ADD97531
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuauugcugaccaacaaagucucuaucagaaugcagaugcauauguuuuuguggggacaucaagauacagcaagaaguucaagccggaaauagcaauaagacccaaagugagggaucaagaagggagaaugaaauauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34892 - RNA, 1701 nt, Artificial Sequence
  hemagglutinin__InfluenzaA__ADD97541
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucauacuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcacauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34893 - RNA, 1701 nt, Artificial Sequence; identical to SEQ ID NO: 34778
  hemagglutinin__InfluenzaA__ADD97551

SEQ ID NO: 34894 - RNA, 1701 nt, Artificial Sequence; identical to SEQ ID NO: 34876
  hemagglutinin__InfluenzaA__ADD97561

SEQ ID NO: 34895 - RNA, 1701 nt, Artificial Sequence
  hemagglutinin__InfluenzaA__ADD97571
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucacuauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguuuuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34896 - RNA, 1701 nt, Artificial Sequence; identical to SEQ ID NO: 33206
  hemagglutinin__InfluenzaA__ADD97581

SEQ ID NO: 34897 - RNA, 1701 nt, Artificial Sequence; identical to SEQ ID NO: 33206
  hemagglutinin__InfluenzaA__ADD97591

SEQ ID NO: 34898 - RNA, 1701 nt, Artificial Sequence
  hemagglutinin__InfluenzaA__ADD97688
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34899 - RNA, 1701 nt, Artificial Sequence; identical to SEQ ID NO: 34778
  hemagglutinin__InfluenzaA__ADD97698

SEQ ID NO: 34900 - RNA, 1701 nt, Artificial Sequence; identical to SEQ ID NO: 34778
  hemagglutinin__InfluenzaA__ADD97888

SEQ ID NO: 34901 - RNA, 1701 nt, Artificial Sequence
  hemagglutinin__InfluenzaA__ADD97898
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34902 - RNA, 1701 nt, Artificial Sequence; identical to SEQ ID NO: 34264
  hemagglutinin__InfluenzaA__ADD97908

SEQ ID NO: 34903 - RNA, 1701 nt, Artificial Sequence
  hemagglutinin__InfluenzaA__ADD97918
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34904 - RNA, 1701 nt, Artificial Sequence
  hemagglutinin__InfluenzaA__ADD97928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaaggggguuggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuucaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34905 - RNA, 1701 nt, Artificial Sequence
  hemagglutinin__InfluenzaA__ADD97938
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaugacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34906 - RNA, 1701 nt, Artificial Sequence
  hemagglutinin__InfluenzaA__ADD97948
augaaggcaauacuauuaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaggggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34907 - RNA, 1701 nt, Artificial Sequence
  hemagglutinin__InfluenzaA__ADD97958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguuccagccggaaauagcaauaagacccaaagugagggaucaagaagggagaaugaacuauuacuggacacuauuagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34908 - RNA, 1701 nt, Artificial Sequence; identical to SEQ ID NO: 34898
  hemagglutinin__InfluenzaA__ADD97968

SEQ ID NO: 34909 - RNA, 1701 nt, Artificial Sequence
  hemagglutinin__InfluenzaA__ADD97978
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34910 - RNA, 1701 nt, Artificial Sequence; identical to SEQ ID NO: 34855
  hemagglutinin__InfluenzaA__ADD97988

SEQ ID NO: 34911 - RNA, 1701 nt, Artificial Sequence
  hemagglutinin__InfluenzaA__ADD97998
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgaaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34912 - RNA, 1701 nt, Artificial Sequence; identical to SEQ ID NO: 34778
  hemagglutinin__InfluenzaA__ADD98008

SEQ ID NO: 34913 - RNA, 1701 nt, Artificial Sequence
  hemagglutinin__InfluenzaA__ADD98018
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaacaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34914 - RNA, 1701 nt, Artificial Sequence
  hemagglutinin__InfluenzaA__ADD98028
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguauguauuuaa

SEQ ID NO: 34915 - RNA, 1701 nt, Artificial Sequence
  hemagglutinin__InfluenzaA__ADD98038
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucaaucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaggcaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgaaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34916 - RNA, 1701 nt, Artificial Sequence
  hemagglutinin__InfluenzaA__ADD98048
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34917 - RNA, 1701 nt, Artificial Sequence; identical to SEQ ID NO: 33206
  hemagglutinin__InfluenzaA__ADD98058

SEQ ID NO: 34918 - RNA, 1701 nt, Artificial Sequence; identical to SEQ ID NO: 33206
  hemagglutinin__InfluenzaA__ADD98068

SEQ ID NO: 34919 - RNA, 1701 nt, Artificial Sequence
  hemagglutinin__InfluenzaA__ADD98078
auggaggcaauacuaguaguucugcuauauacauuugcaaccgcaaaugcagacacauuauguauagguuaucaugcgaacaacucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgacuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucgacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuaguacugguagucucccugggggcaaucaguuucuggaugugcucuaaugggucucuacaguguagaauauguauuuaa

SEQ ID NO: 34920 - RNA, 1701 nt, Artificial Sequence
  hemagglutinin__InfluenzaA__ADD98098
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguucugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaguggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 34921 - RNA, 1701 nt, Artificial Sequence; identical to SEQ ID NO: 34889
  hemagglutinin__InfluenzaA__ADD98118

SEQ ID NO: 34922 - RNA, 1701 nt, Artificial Sequence; identical to SEQ ID NO: 34889
  hemagglutinin__InfluenzaA__ADD98128

SEQ ID NO: 34923 - RNA, 1701 nt, Artificial Sequence
  hemagglutinin__InfluenzaA__ADD98138
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauacuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34924 - RNA, 1701 nt, Artificial Sequence
  hemagglutinin__InfluenzaA__ADD98148
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuuucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34925 - RNA, 1701 nt, Artificial Sequence
  hemagglutinin__InfluenzaA__ADD98158
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcgaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuugauauggcuaguuaaaaaaggaaauucauauccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugauaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34926 - RNA, 1701 nt, Artificial Sequence
  hemagglutinin__InfluenzaA__ADD98168
augaaggcaauacuaguaguucugcuauauacauuugcaaccgcaaaugcagacacauuauguauagguuaucaugcgaacaauucaacagacacuguagacacaguacuagaaaagaauguaacaguaacacacucuauuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggcgacaaaauaacauucgaagcaacuggaaaucuagugguaccgaaauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34927 - RNA, 1701 nt, Artificial Sequence; identical to SEQ ID NO: 34345
  hemagglutinin__InfluenzaA__ADD98188

SEQ ID NO: 34928 - RNA, 1701 nt, Artificial Sequence
  hemagglutinin__InfluenzaA__ADD98198
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccagcaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaaaugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34929 - RNA, 1701 nt, Artificial Sequence; identical to SEQ ID NO: 33173
  hemagglutinin__InfluenzaA__ADD98208

SEQ ID NO: 34930 - RNA, 1701 nt, Artificial Sequence; identical to SEQ ID NO: 33390
  hemagglutinin__InfluenzaA__ADE20321

SEQ ID NO: 34931 - RNA, 1701 nt, Artificial Sequence; identical to SEQ ID NO: 33390
  hemagglutinin__InfluenzaA__ADE20331

SEQ ID NO: 34932 - RNA, 1701 nt, Artificial Sequence
  hemagglutinin__InfluenzaA__ADE20341
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34933 - RNA, 1701 nt, Artificial Sequence; identical to SEQ ID NO: 34761
  hemagglutinin__InfluenzaA__ADE20351

SEQ ID NO: 34934 - RNA, 1701 nt, Artificial Sequence
  hemagglutinin__InfluenzaA__ADE20375
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuugggcaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34935 - RNA, 1701 nt, Artificial Sequence; identical to SEQ ID NO: 34761
  hemagglutinin__InfluenzaA__ADE20388

SEQ ID NO: 34936 - RNA, 1701 nt, Artificial Sequence
  hemagglutinin__InfluenzaA__ADE20628
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34937 - RNA, 1701 nt, Artificial Sequence; identical to SEQ ID NO: 34761
  hemagglutinin__InfluenzaA__ADE20638

SEQ ID NO: 34938 - RNA, 1701 nt, Artificial Sequence; identical to SEQ ID NO: 33390
  hemagglutinin__InfluenzaA__ADE20648

SEQ ID NO: 34939 - RNA, 1701 nt, Artificial Sequence; identical to SEQ ID NO: 34934
  hemagglutinin__InfluenzaA__ADE20658

SEQ ID NO: 34940 - RNA, 1701 nt, Artificial Sequence
  hemagglutinin__InfluenzaA__ADE20668
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacagcagcauguucucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34941 - RNA, 1701 nt, Artificial Sequence; identical to SEQ ID NO: 34761
  hemagglutinin__InfluenzaA__ADE20678

SEQ ID NO: 34942 - RNA, 1701 nt, Artificial Sequence; identical to SEQ ID NO: 34836
  hemagglutinin__InfluenzaA__ADE20688

SEQ ID NO: 34943 - RNA, 1701 nt, Artificial Sequence; identical to SEQ ID NO: 34836
  hemagglutinin__InfluenzaA__ADE20708

SEQ ID NO: 34944 - RNA, 1701 nt, Artificial Sequence; identical to SEQ ID NO: 34932
  hemagglutinin__InfluenzaA__ADE20718

SEQ ID NO: 34945 - RNA, 1701 nt, Artificial Sequence
  hemagglutinin__InfluenzaA__ADE20728
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34946 - RNA, 1701 nt, Artificial Sequence; identical to SEQ ID NO: 34836
  hemagglutinin__InfluenzaA__ADE20738

SEQ ID NO: 34947 - RNA, 1701 nt, Artificial Sequence; identical to SEQ ID NO: 34934
  hemagglutinin__InfluenzaA__ADE20748

SEQ ID NO: 34948 - RNA, 1701 nt, Artificial Sequence; identical to SEQ ID NO: 34945
  hemagglutinin__InfluenzaA__ADE20758

SEQ ID NO: 34949 - RNA, 1701 nt, Artificial Sequence; identical to SEQ ID NO: 33826
  hemagglutinin__InfluenzaA__ADE20768

SEQ ID NO: 34950 - RNA, 1701 nt, Artificial Sequence
  hemagglutinin__InfluenzaA__ADE20778
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34951 - RNA, 1701 nt, Artificial Sequence
  hemagglutinin__InfluenzaA__ADE20788
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34952 - RNA, 1701 nt, Artificial Sequence
  hemagglutinin__InfluenzaA__ADE20808
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaguuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34953 - RNA, 1701 nt, Artificial Sequence
  hemagglutinin__InfluenzaA__ADE20818
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34954 - RNA, 1701 nt, Artificial Sequence; identical to SEQ ID NO: 34895
  hemagglutinin__InfluenzaA__ADE20828

SEQ ID NO: 34955 - RNA, 1701 nt, Artificial Sequence
  hemagglutinin__InfluenzaA__ADE20848
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugauagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34956 - RNA, 1701 nt, Artificial Sequence; identical to SEQ ID NO: 34876
  hemagglutinin__InfluenzaA__ADE20858

SEQ ID NO: 34957 - RNA, 1701 nt, Artificial Sequence
  hemagglutinin__InfluenzaA__ADE20868
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucaccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34958 - RNA, 1701 nt, Artificial Sequence
  hemagglutinin__InfluenzaA__ADE20878
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuauugcugaccaacaaagucucuaucagaaugcagaugcauauguuuuuguggggacaucaagauacagcaagaaguucaagccggaaauagcaauaagacccaaagugagggaucaagaagggagaaugaaauauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34959 - RNA, 1701 nt, Artificial Sequence
  hemagglutinin__InfluenzaA__ADE20888
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuucccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucacugguacugguagucucccugggggcaaucaguuucuggaugugcucuaaugggucucuacaguguagaauauguauuuaa

SEQ ID NO: 34960 - RNA, 1701 nt, Artificial Sequence
  hemagglutinin__InfluenzaA__ADE20898
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaggugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34961 - RNA, 1701 nt, Artificial Sequence; identical to SEQ ID NO: 34924
  hemagglutinin__InfluenzaA__ADE20908

SEQ ID NO: 34962 - RNA, 1701 nt, Artificial Sequence
  hemagglutinin__InfluenzaA__ADE20918
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggauacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34963 - RNA, 1701 nt, Artificial Sequence; identical to SEQ ID NO: 34264
  hemagglutinin__InfluenzaA__ADE20928

SEQ ID NO: 34964 - RNA, 1701 nt, Artificial Sequence
  hemagglutinin__InfluenzaA__ADE20948
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagaccaaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34965 - RNA, 1701 nt, Artificial Sequence
  hemagglutinin__InfluenzaA__ADE20968
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggaagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucauucuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacacaagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34966 - RNA, 1701 nt, Artificial Sequence
  hemagglutinin__InfluenzaA__ADE20978
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcuguuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34967 - RNA, 1701 nt, Artificial Sequence
  hemagglutinin__InfluenzaA__ADE20988
augaaggcaauacuaguaguucugcuauauacauuugcaaccgcaaaugcagacacauuauguauagguuaucaugcgaauaauucaacagacacuguagacacaguacuagaaaagaauguaacaguaacacacucaguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaaaagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34968 - RNA, 1701 nt, Artificial Sequence
  hemagglutinin__InfluenzaA__ADE20998
augaaggcaauacuaguaguucugcuguauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34969 - RNA, 1701 nt, Artificial Sequence; identical to SEQ ID NO: 34501
  hemagglutinin__InfluenzaA__ADE21008

SEQ ID NO: 34970 - RNA, 1701 nt, Artificial Sequence
  hemagglutinin__InfluenzaA__ADE21018
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34971 - RNA, 1701 nt, Artificial Sequence; identical to SEQ ID NO: 34911
  hemagglutinin__InfluenzaA__ADE21028

SEQ ID NO: 34972 - RNA, 1701 nt, Artificial Sequence
  hemagglutinin__InfluenzaA__ADE21038
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34973 - RNA, 1701 nt, Artificial Sequence; identical to SEQ ID NO: 34924
  hemagglutinin__InfluenzaA__ADE21048

SEQ ID NO: 34974 - RNA, 1701 nt, Artificial Sequence
  hemagglutinin__InfluenzaA__ADE21058
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaauaaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34975 - RNA, 1701 nt, Artificial Sequence
  hemagglutinin__InfluenzaA__ADE21068
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagaucuucccuaagacaaguucauggcccaaucaugacucgaauaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaacuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34976 - RNA, 1698 nt, Artificial Sequence
  hemagglutinin__InfluenzaA__ADE28761
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguucacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugaauccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaauggaagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 34977 - RNA, 1701 nt, Artificial Sequence; identical to SEQ ID NO: 33390
  hemagglutinin__InfluenzaA__ADE28780

SEQ ID NO: 34978 - RNA, 1701 nt, Artificial Sequence; identical to SEQ ID NO: 34761
  hemagglutinin__InfluenzaA__ADE28790

SEQ ID NO: 34979 - RNA, 1701 nt, Artificial Sequence
  hemagglutinin__InfluenzaA__ADE28800
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguuuaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34980 - RNA, 1701 nt, Artificial Sequence; identical to SEQ ID NO: 34951
  hemagglutinin__InfluenzaA__ADE28810

SEQ ID NO: 34981 - RNA, 1701 nt, Artificial Sequence
  hemagglutinin__InfluenzaA__ADE28820
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaguccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34982 - RNA, 1701 nt, Artificial Sequence
  hemagglutinin__InfluenzaA__ADE28830
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34983 - RNA, 1701 nt, Artificial Sequence; identical to SEQ ID NO: 34982
  hemagglutinin__InfluenzaA__ADE28840

SEQ ID NO: 34984 - RNA, 1701 nt, Artificial Sequence
  hemagglutinin__InfluenzaA__ADE28850
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34985 - RNA, 1701 nt, Artificial Sequence; identical to SEQ ID NO: 34982
  hemagglutinin__InfluenzaA__ADE28881

SEQ ID NO: 34986 - RNA, 1701 nt, Artificial Sequence; identical to SEQ ID NO: 33826
  hemagglutinin__InfluenzaA__ADE28891

SEQ ID NO: 34987 - RNA, 1701 nt, Artificial Sequence; identical to SEQ ID NO: 34863
  hemagglutinin__InfluenzaA__ADE28911

SEQ ID NO: 34988 - RNA, 1701 nt, Artificial Sequence; identical to SEQ ID NO: 34875
  hemagglutinin__InfluenzaA__ADE28921

SEQ ID NO: 34989 - RNA, 1701 nt, Artificial Sequence
  hemagglutinin__InfluenzaA__ADE28931
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuaguagucucccugggggcaaucaguuucuggaugugcucuaaugggucucuacaguguagaauauguauuuaa

SEQ ID NO: 34990 - RNA, 1701 nt, Artificial Sequence; identical to SEQ ID NO: 34264
  hemagglutinin__InfluenzaA__ADE28951

SEQ ID NO: 34991 - RNA, 1701 nt, Artificial Sequence
  hemagglutinin__InfluenzaA__ADE28961
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacguugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34992 - RNA, 1701 nt, Artificial Sequence; identical to SEQ ID NO: 34877
  hemagglutinin__InfluenzaA__ADE28971

SEQ ID NO: 34993 - RNA, 1701 nt, Artificial Sequence
  hemagglutinin__InfluenzaA__ADE28981
augaaggcaauacuaguaguucugcuauauacauuugcaaccgcaaaugcagacacauuauguauagguuaucaugcgaacaauucaacagaaacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuaccaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34994 - RNA, 1701 nt, Artificial Sequence; identical to SEQ ID NO: 34337
  hemagglutinin__InfluenzaA__ADE28991

SEQ ID NO: 34995 - RNA, 1701 nt, Artificial Sequence
  hemagglutinin__InfluenzaA__ADE29001
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggauggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34996 - RNA, 1701 nt, Artificial Sequence; identical to SEQ ID NO: 34356
  hemagglutinin__InfluenzaA__ADE29011

SEQ ID NO: 34997 - RNA, 1701 nt, Artificial Sequence
  hemagglutinin__InfluenzaA__ADE29021
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucugguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuucuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34998 - RNA, 1701 nt, Artificial Sequence
  hemagglutinin__InfluenzaA__ADE29031
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaccaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 34999 - RNA, 1701 nt, Artificial Sequence
  hemagglutinin__InfluenzaA__ADE29041
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35000 - RNA, 1701 nt, Artificial Sequence
  hemagglutinin__InfluenzaA__ADE29051
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35001 - RNA, 1701 nt, Artificial Sequence
  hemagglutinin__InfluenzaA__ADE29085
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcugaggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35002 - RNA, 1701 nt, Artificial Sequence
  hemagglutinin__InfluenzaA__ADE29095
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagacguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35003 - RNA, 1701 nt, Artificial Sequence; identical to SEQ ID NO: 34094
  hemagglutinin__InfluenzaA__ADE34191

SEQ ID NO: 35004 - RNA, 1701 nt, Artificial Sequence
  hemagglutinin__InfluenzaA__ADE34202
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauuaaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35005 - RNA, 1701 nt, Artificial Sequence
  hemagglutinin__InfluenzaA__ADE34213
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgacgcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaccaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35006 - RNA, 1701 nt, Artificial Sequence; identical to SEQ ID NO: 34094
  hemagglutinin__InfluenzaA__ADE34224

SEQ ID NO: 35007 - RNA, 1701 nt, Artificial Sequence
  hemagglutinin__InfluenzaA__ADE34235
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaccacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35008 - RNA, 1701 nt, Artificial Sequence
  hemagglutinin__InfluenzaA__ADE34246
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacacacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35009 - RNA, 1701 nt, Artificial Sequence
  hemagglutinin__InfluenzaA__ADE34257
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacugauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35010 - RNA, 1701 nt, Artificial Sequence
  hemagglutinin__InfluenzaA__ADE34268
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaggugccggauuaugccucccuuaggucacuaguugccucauccggcacacuggaguuuaacaaugaaagcuucaauuggacuggagucacucaagacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuuuaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35011 - RNA, 1701 nt, Artificial Sequence
  hemagglutinin__InfluenzaA__ADE45499
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35012 - RNA, 1701 nt, Artificial Sequence
  hemagglutinin__InfluenzaA__ADE45501
augaaggcaauacuaguaguucugcuauauacauuugcaaccgcaaaugcagacacacuauguauagguuaucaugcgaacaauucaacagacacuguagacacaguacuagaaaagaaugugacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaucagauuuuggcgaucuauucaacugucgccaguucauugguacugguagucucccugggggcaaucaguuucuggaugugcucuaaugggucucuacaguguagaauauguauuuaa

SEQ ID NO: 35013 - RNA, 1701 nt, Artificial Sequence
  hemagglutinin__InfluenzaA__ADE45503
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugccuucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 35014 - RNA, 1701 nt, Artificial Sequence
  hemagglutinin__InfluenzaA__ADE45505
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggagauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguggucucccugggggcaaucaguuucuggaugugcucuaaugggucucuacaguguagaauauguauuuaa

SEQ ID NO: 35015 - RNA, 1701 nt, Artificial Sequence
  hemagglutinin__InfluenzaA__ADE45507
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggagcaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35016 - RNA, 1701 nt, Artificial Sequence; identical to SEQ ID NO: 35015
  hemagglutinin__InfluenzaA__ADE45509

SEQ ID NO: 35017 - RNA, 1701 nt, Artificial Sequence
  hemagglutinin__InfluenzaA__ADE45511
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35018 - RNA, 1701 nt, Artificial Sequence
  hemagglutinin__InfluenzaA__ADE45513
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaauuaacuauuacuggacacuaguagagccgggagacaaaauaauauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35019 - RNA, 1701 nt, Artificial Sequence
  hemagglutinin__InfluenzaA__ADE75388
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagaaaauggaacauguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35020 - RNA, 1701 nt, Artificial Sequence; identical to SEQ ID NO: 33173
  hemagglutinin__InfluenzaA__ADE75390

SEQ ID NO: 35021 - RNA, 1701 nt, Artificial Sequence
  hemagglutinin__InfluenzaA__ADF10067
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35022 - RNA, 1701 nt, Artificial Sequence
  hemagglutinin__InfluenzaA__ADF10077
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaagguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucccuacaguguagaauauguauuuaa

SEQ ID NO: 35023 - RNA, 1701 nt, Artificial Sequence
  hemagglutinin__InfluenzaA__ADF10087
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaaugaaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35024 - RNA, 1701 nt, Artificial Sequence
  hemagglutinin__InfluenzaA__ADF10097
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35025 - RNA, 1701 nt, Artificial Sequence
  hemagglutinin__InfluenzaA__ADF10107
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35026 - RNA, 1701 nt, Artificial Sequence; identical to SEQ ID NO: 33173
  hemagglutinin__InfluenzaA__ADF10117

SEQ ID NO: 35027 - RNA, 1701 nt, Artificial Sequence
  hemagglutinin__InfluenzaA__ADF10127
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguaugcauuuaa

SEQ ID NO: 35028 - RNA, 1701 nt, Artificial Sequence; identical to SEQ ID NO: 33173
  hemagglutinin__InfluenzaA__ADF10137

SEQ ID NO: 35029 - RNA, 1701 nt, Artificial Sequence
  hemagglutinin__InfluenzaA__ADF10154
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35030 - RNA, 1701 nt, Artificial Sequence
  hemagglutinin__InfluenzaA__ADF10174
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35031 - RNA, 1701 nt, Artificial Sequence
  hemagglutinin__InfluenzaA__ADF10190
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35032 - RNA, 1701 nt, Artificial Sequence; identical to SEQ ID NO: 34877
  hemagglutinin__InfluenzaA__ADF10237

SEQ ID NO: 35033 - RNA, 1701 nt, Artificial Sequence; identical to SEQ ID NO: 35031
  hemagglutinin__InfluenzaA__ADF10262

SEQ ID NO: 35034 - RNA, 1701 nt, Artificial Sequence
  hemagglutinin__InfluenzaA__ADF10288
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguaugcauuuaa

SEQ ID NO: 35035 - RNA, 1701 nt, Artificial Sequence
  hemagglutinin__InfluenzaA__ADF10302
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaguaugcauuuaa

SEQ ID NO: 35036 - RNA, 1701 nt, Artificial Sequence; identical to SEQ ID NO: 34877
  hemagglutinin__InfluenzaA__ADF10335

SEQ ID NO: 35037 - RNA, 1701 nt, Artificial Sequence; identical to SEQ ID NO: 34877
  hemagglutinin__InfluenzaA__ADF10359

SEQ ID NO: 35038 - RNA, 1701 nt, Artificial Sequence; identical to SEQ ID NO: 35031
  hemagglutinin__InfluenzaA__ADF10369

SEQ ID NO: 35039 - RNA, 1701 nt, Artificial Sequence; identical to SEQ ID NO: 35031
  hemagglutinin__InfluenzaA__ADF10390

SEQ ID NO: 35040 - RNA, 1701 nt, Artificial Sequence; identical to SEQ ID NO: 34877
  hemagglutinin__InfluenzaA__ADF10528

SEQ ID NO: 35041 - RNA, 1701 nt, Artificial Sequence
  hemagglutinin__InfluenzaA__ADF10598
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuauccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35042 - RNA, 1701 nt, Artificial Sequence; identical to SEQ ID NO: 35031
  hemagglutinin__InfluenzaA__ADF10670

SEQ ID NO: 35043 - RNA, 1701 nt, Artificial Sequence; identical to SEQ ID NO: 35031
  hemagglutinin__InfluenzaA__ADF10724

SEQ ID NO: 35044 - RNA, 1701 nt, Artificial Sequence; identical to SEQ ID NO: 35035
  hemagglutinin__InfluenzaA__ADF10757

SEQ ID NO: 35045 - RNA, 1701 nt, Artificial Sequence
  hemagglutinin__InfluenzaA__ADF10828
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35046 - RNA, 1701 nt, Artificial Sequence
  hemagglutinin__InfluenzaA__ADF10874
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauuguaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaaaaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35047 - RNA, 1701 nt, Artificial Sequence; identical to SEQ ID NO: 33796
  hemagglutinin__InfluenzaA__ADF10929

SEQ ID NO: 35048 - RNA, 1701 nt, Artificial Sequence; identical to SEQ ID NO: 33796
  hemagglutinin__InfluenzaA__ADF10996

SEQ ID NO: 35049 - RNA, 1701 nt, Artificial Sequence
  hemagglutinin__InfluenzaA__ADF27367
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggauggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35050 - RNA, 1701 nt, Artificial Sequence; identical to SEQ ID NO: 33173
  hemagglutinin__InfluenzaA__ADF27369

SEQ ID NO: 35051 - RNA, 1701 nt, Artificial Sequence
  hemagglutinin__InfluenzaA__ADF27370
augaaggcaauacuaguaauucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuugguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggcuauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35052 - RNA, 1701 nt, Artificial Sequence; identical to SEQ ID NO: 34345
  hemagglutinin__InfluenzaA__ADF27371

SEQ ID NO: 35053 - RNA, 1701 nt, Artificial Sequence
  hemagglutinin__InfluenzaA__ADF27372
augaaggcaauacuaguaguucugcuauauacauuugcaaccgcaaaugcagacacauuauguauagguuaucauacgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35054 - RNA, 1701 nt, Artificial Sequence
  hemagglutinin__InfluenzaA__ADF27373
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaauagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaacuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35055 - RNA, 1701 nt, Artificial Sequence
  hemagglutinin__InfluenzaA__ADF27374
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35056 - RNA, 1701 nt, Artificial Sequence
  hemagglutinin__InfluenzaA__ADF27375
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacugggaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccagaagagcacacagaaugccauugacgagauuacuaacaaaauaaauucuguuauugaaaagaugaauacacaguucacagcaguaggcaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35057 - RNA, 1701 nt, Artificial Sequence
  hemagglutinin__InfluenzaA__ADF27376
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagaaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35058 - RNA, 1701 nt, Artificial Sequence
  hemagglutinin__InfluenzaA__ADF27378
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaggagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35059 - RNA, 1701 nt, Artificial Sequence
  hemagglutinin__InfluenzaA__ADF27389
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucacuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggaucuaccagauuuuggcgaucuauucaacugucgccaguucauugguacugguagucucccugggggcaaucaguuucuggaugugcucuaaugggucucuacaguguagaauauguauuuaa

SEQ ID NO: 35060 - RNA, 1701 nt, Artificial Sequence
  hemagglutinin__InfluenzaA__ADF27399
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 35061 - RNA, 1701 nt, Artificial Sequence; identical to SEQ ID NO: 34337
  hemagglutinin__InfluenzaA__ADF27409

SEQ ID NO: 35062 - RNA, 1701 nt, Artificial Sequence
  hemagglutinin__InfluenzaA__ADF27419
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35063 - RNA, 1701 nt, Artificial Sequence
  hemagglutinin__InfluenzaA__ADF27429
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauucuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcaugaaaagugucaaaaaugggacuuaugacuacccaaaauacuccgaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35064 - RNA, 1701 nt, Artificial Sequence
  hemagglutinin__InfluenzaA__ADF27439
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaccaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35065 - RNA, 1701 nt, Artificial Sequence
  hemagglutinin__InfluenzaA__ADF27449
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35066 - RNA, 1701 nt, Artificial Sequence; identical to SEQ ID NO: 34333
  hemagglutinin__InfluenzaA__ADF27459

SEQ ID NO: 35067 - RNA, 1701 nt, Artificial Sequence
  hemagglutinin__InfluenzaA__ADF27469
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccagcaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggguaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35068 - RNA, 1701 nt, Artificial Sequence
  hemagglutinin__InfluenzaA__ADF27479
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucauucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35069 - RNA, 1701 nt, Artificial Sequence
  hemagglutinin__InfluenzaA__ADF27489
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaauacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggagaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucuggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35070 - RNA, 1701 nt, Artificial Sequence
  hemagglutinin__InfluenzaA__ADF27499
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35071 - RNA, 1701 nt, Artificial Sequence
  hemagglutinin__InfluenzaA__ADF27509
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagucucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35072 - RNA, 1701 nt, Artificial Sequence
  hemagglutinin__InfluenzaA__ADF27529
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35073 - RNA, 1701 nt, Artificial Sequence
  hemagglutinin__InfluenzaA__ADF27539
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauauucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35074 - RNA, 1701 nt, Artificial Sequence; identical to SEQ ID NO: 34345
  hemagglutinin__InfluenzaA__ADF27549

SEQ ID NO: 35075 - RNA, 1701 nt, Artificial Sequence
  hemagglutinin__InfluenzaA__ADF27559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcugguuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35076 - RNA, 1701 nt, Artificial Sequence
  hemagglutinin__InfluenzaA__ADF27569
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagagugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35077 - RNA, 1701 nt, Artificial Sequence
  hemagglutinin__InfluenzaA__ADF27579
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35078 - RNA, 1701 nt, Artificial Sequence
  hemagglutinin__InfluenzaA__ADF27589
augaaggcaauacugguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35079 - RNA, 1701 nt, Artificial Sequence
  hemagglutinin__InfluenzaA__ADF27599
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguuuuauuggaaaaugaaagaacuuuagacuaccacgauucaaaugugaagaacuuauaugaaaagguaagaagccaguuaaaaagcaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35080 - RNA, 1701 nt, Artificial Sequence
  hemagglutinin__InfluenzaA__ADF27609
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugugacggcagcauguccucaagcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccagcucauugguacugguagucucccugggggcaaucaguuucuggaugugcucuaaugggucucuacaguguagaauauguauuuaa

SEQ ID NO: 35081 - RNA, 1701 nt, Artificial Sequence
  hemagglutinin__InfluenzaA__ADF27619
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagucccauugcauuuggguaaauguaacauugcuggcuggauccugggaaauccagagugugaaucacucuccacagcaagcucaugguccuacauuguggaaacaucuaguucagacaauggaacgugcuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35082 - RNA, 1701 nt, Artificial Sequence
  hemagglutinin__InfluenzaA__ADF27629
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccacugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35083 - RNA, 1701 nt, Artificial Sequence
  hemagglutinin__InfluenzaA__ADF27649
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaccuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35084 - RNA, 1701 nt, Artificial Sequence; identical to SEQ ID NO: 34345
  hemagglutinin__InfluenzaA__ADF27659

SEQ ID NO: 35085 - RNA, 1701 nt, Artificial Sequence; identical to SEQ ID NO: 35000
  hemagglutinin__InfluenzaA__ADF27669

SEQ ID NO: 35086 - RNA, 1701 nt, Artificial Sequence
  hemagglutinin__InfluenzaA__ADF27679
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagguacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35087 - RNA, 1701 nt, Artificial Sequence
  hemagglutinin__InfluenzaA__ADF27689
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacguuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35088 - RNA, 1701 nt, Artificial Sequence
  hemagglutinin__InfluenzaA__ADF27699
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacagcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguucacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35089 - RNA, 1701 nt, Artificial Sequence
  hemagglutinin__InfluenzaA__ADF27709
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaauaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35090 - RNA, 1701 nt, Artificial Sequence
  hemagglutinin__InfluenzaA__ADF27785
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggacugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35091 - RNA, 1701 nt, Artificial Sequence
  hemagglutinin__InfluenzaA__ADF27795
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35092 - RNA, 1701 nt, Artificial Sequence
  hemagglutinin__InfluenzaA__ADF27805
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggagacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcuauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35093 - RNA, 1701 nt, Artificial Sequence
  hemagglutinin__InfluenzaA__ADF27815
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugauggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35094 - RNA, 1701 nt, Artificial Sequence
  hemagglutinin__InfluenzaA__ADF27825
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauucugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35095 - RNA, 1701 nt, Artificial Sequence
  hemagglutinin__InfluenzaA__ADF27845
augaaggcaauacuaguaguucugcuauauacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35096 - RNA, 1701 nt, Artificial Sequence
  hemagglutinin__InfluenzaA__ADF27855
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugaacaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35097 - RNA, 1701 nt, Artificial Sequence; identical to SEQ ID NO: 35096
  hemagglutinin__InfluenzaA__ADF27865

SEQ ID NO: 35098 - RNA, 1701 nt, Artificial Sequence; identical to SEQ ID NO: 35096
  hemagglutinin__InfluenzaA__ADF27875

SEQ ID NO: 35099 - RNA, 1701 nt, Artificial Sequence
  hemagglutinin__InfluenzaA__ADF27885
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35100 - RNA, 1701 nt, Artificial Sequence
  hemagglutinin__InfluenzaA__ADF27895
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35101 - RNA, 1701 nt, Artificial Sequence
  hemagglutinin__InfluenzaA__ADF27915
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucugcuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaauguagaauauguauuuaa

SEQ ID NO: 35102 - RNA, 1701 nt, Artificial Sequence
  hemagglutinin__InfluenzaA__ADF27925
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagaauggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35103 - RNA, 1701 nt, Artificial Sequence
  hemagglutinin__InfluenzaA__ADF27935
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccaaagugugaaucacucuccacagaaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuauaaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35104 - RNA, 1701 nt, Artificial Sequence
  hemagglutinin__InfluenzaA__ADF27955
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaacuccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuacucaacugucgccaguucauugguacugguagucucccugggggcaaucaguuucuggaugugcucuaaugggucucuacaguguagaauauguauuuaa

SEQ ID NO: 35105 - RNA, 1701 nt, Artificial Sequence
  hemagglutinin__InfluenzaA__ADF27965
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagucaacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguaggcaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35106 - RNA, 1701 nt, Artificial Sequence
  hemagglutinin__InfluenzaA__ADF27975
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauuuuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuuuauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggaccuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35107 - RNA, 1701 nt, Artificial Sequence
  hemagglutinin__InfluenzaA__ADF27985
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguggccccauugcauuuggguaaauguaacauugcuggcuggauccugggaaauccagagugugaaucacucuccacagcaagcucaugguccuacauuguggagacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35108 - RNA, 1701 nt, Artificial Sequence
  hemagglutinin__InfluenzaA__ADF27995
augaaggcaauacuaguaguucugcuauauacauuugcaaccgcaaaugcagacacauuauguauagguuaucaugcgaacaauucaacagacacuguagacacaguacuagaaaagaauguaacaguaacacacucugcuaaccuucuagaagauaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaaugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35109 - RNA, 1701 nt, Artificial Sequence; identical to SEQ ID NO: 34731
  hemagglutinin__InfluenzaA__ADF28005

SEQ ID NO: 35110 - RNA, 1701 nt, Artificial Sequence; identical to SEQ ID NO: 34731
  hemagglutinin__InfluenzaA__ADF28015

SEQ ID NO: 35111 - RNA, 1701 nt, Artificial Sequence; identical to SEQ ID NO: 34337
  hemagglutinin__InfluenzaA__ADF28025

SEQ ID NO: 35112 - RNA, 1701 nt, Artificial Sequence; identical to SEQ ID NO: 34337
  hemagglutinin__InfluenzaA__ADF28045

SEQ ID NO: 35113 - RNA, 1701 nt, Artificial Sequence
  hemagglutinin__InfluenzaA__ADF28055
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaauuaugacucgaacaaagguguaacggcagcauguccucaugcuggagcaaagagcuucuauaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35114 - RNA, 1701 nt, Artificial Sequence
  hemagglutinin__InfluenzaA__ADF28065
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaagaauuuaccagauuuuggcgaucuauucaacugucgccaguucauugguacugguagucucccugggggcaaucaguuucuggaugugcucuaaugggucucuacaguguagaauauguauuuaa

SEQ ID NO: 35115 - RNA, 1701 nt, Artificial Sequence
  hemagglutinin__InfluenzaA__ADF28075
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcugguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucggauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35116 - RNA, 1701 nt, Artificial Sequence; identical to SEQ ID NO: 34281
  hemagglutinin__InfluenzaA__ADF28085

SEQ ID NO: 35117 - RNA, 1701 nt, Artificial Sequence
  hemagglutinin__InfluenzaA__ADF28107
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35118 - RNA, 1701 nt, Artificial Sequence
  hemagglutinin__InfluenzaA__ADF28117
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35119 - RNA, 1701 nt, Artificial Sequence
  hemagglutinin__InfluenzaA__ADF29918
augaaggcaauacuaguaguacugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcagauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35120 - RNA, 1701 nt, Artificial Sequence
  hemagglutinin__InfluenzaA__ADF42689
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuggcagucucccugggggcaaucgguuucuggaugugcucuaaugggucucuacaguguagaauauguauuuaa

SEQ ID NO: 35121 - RNA, 1701 nt, Artificial Sequence
  hemagglutinin__InfluenzaA__ADF42699
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggacacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauauccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35122 - RNA, 1701 nt, Artificial Sequence; identical to SEQ ID NO: 35096
  hemagglutinin__InfluenzaA__ADF42709

SEQ ID NO: 35123 - RNA, 1701 nt, Artificial Sequence
  hemagglutinin__InfluenzaA__ADF42719
augaaggcaauacuaguaguucugcuauauacauuugcaaccgcaaaugcagacacauuauguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccuggggaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35124 - RNA, 1701 nt, Artificial Sequence; identical to SEQ ID NO: 34818
  hemagglutinin__InfluenzaA__ADF42729

SEQ ID NO: 35125 - RNA, 1701 nt, Artificial Sequence; identical to SEQ ID NO: 34337
  hemagglutinin__InfluenzaA__ADF42739

SEQ ID NO: 35126 - RNA, 1701 nt, Artificial Sequence
  hemagglutinin__InfluenzaA__ADF58349
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35127 - RNA, 1701 nt, Artificial Sequence
  hemagglutinin__InfluenzaA__ADF58351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35128 - RNA, 1701 nt, Artificial Sequence
  hemagglutinin__InfluenzaA__ADF80454
augaaggcaauacuaguaguucugcuauauacauuugcaacugcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgaugacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35129 - RNA, 1701 nt, Artificial Sequence
  hemagglutinin__InfluenzaA__ADF80462
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucgauuaugaggagcuaagagagcaguugagcucagugucaucauuugaaagguuugagauauuccccaagauaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguugaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35130 - RNA, 1701 nt, Artificial Sequence
  hemagglutinin__InfluenzaA__ADF80470
augaaggcaauacuaguaguucugcuauauacauuugcaaccgcaaaugcagacacauuauguauagguuaucaugcaaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35131 - RNA, 1701 nt, Artificial Sequence
  hemagglutinin__InfluenzaA__ADF80478
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaaugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35132 - RNA, 1701 nt, Artificial Sequence
  hemagglutinin__InfluenzaA__ADF80494
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacucuugguucuauuggaaaaugaaagaacuuuggacuaccacgauucaaaugugaagaacuuauaugaaaagguaagaagccaguuaaaaaccaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35133 - RNA, 1701 nt, Artificial Sequence; identical to SEQ ID NO: 35132
  hemagglutinin__InfluenzaA__ADF80498

SEQ ID NO: 35134 - RNA, 1701 nt, Artificial Sequence
  hemagglutinin__InfluenzaA__ADF80502
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucgaacaaagguguaacgacagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugccgaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35135 - RNA, 1701 nt, Artificial Sequence
  hemagglutinin__InfluenzaA__ADF80506
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguagcauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35136 - RNA, 1701 nt, Artificial Sequence
  hemagglutinin__InfluenzaA__ADF83741
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacaaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaguaaugagaucagaugcacccauuggcaaaugcaauucugauugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucguacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35137 - RNA, 1701 nt, Artificial Sequence
  hemagglutinin__InfluenzaA__ADF83752
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35138 - RNA, 1701 nt, Artificial Sequence
  hemagglutinin__InfluenzaA__ADF83763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguaaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35139 - RNA, 1701 nt, Artificial Sequence; identical to SEQ ID NO: 34731
  hemagglutinin__InfluenzaA__ADF83773

SEQ ID NO: 35140 - RNA, 1701 nt, Artificial Sequence
  hemagglutinin__InfluenzaA__ADF83783
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaggaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaccacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35141 - RNA, 1701 nt, Artificial Sequence
  hemagglutinin__InfluenzaA__ADF83793
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccuggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35142 - RNA, 1701 nt, Artificial Sequence
  hemagglutinin__InfluenzaA__ADF83803
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaacacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacauuuggacuuacaaugccgaacuguugguucuauuggaaaaugaaagaacuuuggacuaccacgauucaaaugugaagaacuuauaugaaaagguaagaagccaguuaaaaaacaaugccaaggaaacuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35143 - RNA, 1701 nt, Artificial Sequence
  hemagglutinin__InfluenzaA__ADF83813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagcacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35144 - RNA, 1701 nt, Artificial Sequence
  hemagglutinin__InfluenzaA__ADF83823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuauugguucuauuagaaaaugaaagaacuuuagacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35145 - RNA, 1701 nt, Artificial Sequence
  hemagglutinin__InfluenzaA__ADF83833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugauucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35146 - RNA, 1701 nt, Artificial Sequence; identical to SEQ ID NO: 35145
  hemagglutinin__InfluenzaA__ADF83843

SEQ ID NO: 35147 - RNA, 1701 nt, Artificial Sequence; identical to SEQ ID NO: 34731
  hemagglutinin__InfluenzaA__ADF83853

SEQ ID NO: 35148 - RNA, 1701 nt, Artificial Sequence
  hemagglutinin__InfluenzaA__ADF83873
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35149 - RNA, 1701 nt, Artificial Sequence
  hemagglutinin__InfluenzaA__ADF83885
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35150 - RNA, 1701 nt, Artificial Sequence
  hemagglutinin__InfluenzaA__ADF83895
augaaggcaauacuaguaguucugcuauauacauuugcaaccguaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagauaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35151 - RNA, 1701 nt, Artificial Sequence
  hemagglutinin__InfluenzaA__ADF83915
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucaaaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35152 - RNA, 1701 nt, Artificial Sequence
  hemagglutinin__InfluenzaA__ADF84441
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccagucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauauacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35153 - RNA, 1701 nt, Artificial Sequence
  hemagglutinin__InfluenzaA__ADF84459
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccuaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35154 - RNA, 1701 nt, Artificial Sequence; identical to SEQ ID NO: 34778
  hemagglutinin__InfluenzaA__ADF84469

SEQ ID NO: 35155 - RNA, 1701 nt, Artificial Sequence
  hemagglutinin__InfluenzaA__ADF84479
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35156 - RNA, 1701 nt, Artificial Sequence; identical to SEQ ID NO: 34778
  hemagglutinin__InfluenzaA__ADF84489

SEQ ID NO: 35157 - RNA, 1701 nt, Artificial Sequence
  hemagglutinin__InfluenzaA__ADF85017
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35158 - RNA, 1701 nt, Artificial Sequence
  hemagglutinin__InfluenzaA__ADF87152
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaauuaagagggguagccccauugcauuuggguaaauguaauauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35159 - RNA, 1701 nt, Artificial Sequence
  hemagglutinin__InfluenzaA__ADF87162
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaaaauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35160 - RNA, 1701 nt, Artificial Sequence; identical to SEQ ID NO: 34778
  hemagglutinin__InfluenzaA__ADF87172

SEQ ID NO: 35161 - RNA, 1701 nt, Artificial Sequence
  hemagglutinin__InfluenzaA__ADF87182
augaaugcaauacuaguaguucugcuauauacauuugcaaccgcaaaugcagacacauuauguauagguuaucaugcgaacaauucaacagacacuguagacacauuacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaauaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35162 - RNA, 1701 nt, Artificial Sequence; identical to SEQ ID NO: 34778
  hemagglutinin__InfluenzaA__ADF87192

SEQ ID NO: 35163 - RNA, 1701 nt, Artificial Sequence
  hemagglutinin__InfluenzaA__ADF87202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauuugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35164 - RNA, 1701 nt, Artificial Sequence
  hemagglutinin__InfluenzaA__ADF87212
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugaggcuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35165 - RNA, 1701 nt, Artificial Sequence
  hemagglutinin__InfluenzaA__ADF87232
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggaagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacacaagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35166 - RNA, 1701 nt, Artificial Sequence; identical to SEQ ID NO: 34778
  hemagglutinin__InfluenzaA__ADF87242

SEQ ID NO: 35167 - RNA, 1701 nt, Artificial Sequence
  hemagglutinin__InfluenzaA__ADF87252
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaaaucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguuuaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35168 - RNA, 1701 nt, Artificial Sequence; identical to SEQ ID NO: 34778
  hemagglutinin__InfluenzaA__ADF87262

SEQ ID NO: 35169 - RNA, 1701 nt, Artificial Sequence
  hemagglutinin__InfluenzaA__ADF87272
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuucuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35170 - RNA, 1701 nt, Artificial Sequence; identical to SEQ ID NO: 35169
  hemagglutinin__InfluenzaA__ADF87282

SEQ ID NO: 35171 - RNA, 1701 nt, Artificial Sequence
  hemagglutinin__InfluenzaA__ADF87292
augaaggcaauacuaguaguucugcuauauacauuugcaaccgcaaaugcagacacauuauguauagguuaucacgcgaacaauucaacagacacuguagacacaguacuaaaaaagaauguaacaguaacacacucgguuaaccuucuagaagacaagcauaacgggaaacuaugcaaacuaagagggguagccccauugcauuuggguaaauguaacauugcuggcuggauccugggaaauccagagugugaaucacucuccacagcaggcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcuauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacaugugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35172 - RNA, 1701 nt, Artificial Sequence; identical to SEQ ID NO: 34337
  hemagglutinin__InfluenzaA__ADF87302

SEQ ID NO: 35173 - RNA, 1701 nt, Artificial Sequence
  hemagglutinin__InfluenzaA__ADF87331
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaauucagacaauggaacguguuacccaggagauuucaucaauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35174 - RNA, 1701 nt, Artificial Sequence
  hemagglutinin__InfluenzaA__ADF87341
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguuaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35175 - RNA, 1701 nt, Artificial Sequence
  hemagglutinin__InfluenzaA__ADF87351
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugacucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguauugguagucucccugggggcaaucaguuucuggaugugcucuaaugggucucuacaguguagaauauguauuuaa

SEQ ID NO: 35176 - RNA, 1701 nt, Artificial Sequence
  hemagglutinin__InfluenzaA__ADF87361
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaccaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35177 - RNA, 1701 nt, Artificial Sequence; identical to SEQ ID NO: 34714
  hemagglutinin__InfluenzaA__ADF87371

SEQ ID NO: 35178 - RNA, 1701 nt, Artificial Sequence
  hemagglutinin__InfluenzaA__ADG08115
augaaggcaauacuaguaguucugcuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacuggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuuuugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35179 - RNA, 1701 nt, Artificial Sequence; identical to SEQ ID NO: 34103
  hemagglutinin__InfluenzaA__ADG21004

SEQ ID NO: 35180 - RNA, 1701 nt, Artificial Sequence; identical to SEQ ID NO: 34103
  hemagglutinin__InfluenzaA__ADG21006

SEQ ID NO: 35181 - RNA, 1701 nt, Artificial Sequence
  hemagglutinin__InfluenzaA__ADG21008
augaagacuaucauugcuuugagcuacauucuaugucugguuuucgcucaaaaaauuccugggaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaauccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggcaugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35182 - RNA, 1701 nt, Artificial Sequence
  hemagglutinin__InfluenzaA__ADG21009
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaagauucaaguacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacaccaaauggaagcauucccaaugacaaaccauuccaaaauguaaacaggaucacauacggggcuugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucggaaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35183 - RNA, 1701 nt, Artificial Sequence
  hemagglutinin__InfluenzaA__ADG21010
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaaguugaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 35184 - RNA, 1701 nt, Artificial Sequence
  hemagglutinin__InfluenzaA__ADG21011
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaagggauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35185 - RNA, 1701 nt, Artificial Sequence
  hemagglutinin__InfluenzaA__ADG21012
augaagacuaucauugcuuugagcuacauucuaugccugguuuucgcucaaaaacuuccuggaaaugacaacagcacggcaacgcuaugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguuuacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35186 - RNA, 1701 nt, Artificial Sequence
  hemagglutinin__InfluenzaA__ADG21013
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuaccaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaaguugaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35187 - RNA, 1701 nt, Artificial Sequence
  hemagglutinin__InfluenzaA__ADG21014
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuaccaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35188 - RNA, 1701 nt, Artificial Sequence
  hemagglutinin__InfluenzaA__ADG21017
augaagacuaucauugcuuugagcuacauucuauaucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuauugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguaugguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35189 - RNA, 1701 nt, Artificial Sequence
  hemagglutinin__InfluenzaA__ADG21018
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcuaguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacucaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacacagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaaaaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35190 - RNA, 1701 nt, Artificial Sequence
  hemagglutinin__InfluenzaA__ADG21019
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagauacucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaaaaaucauagucucuaccaaaagaagccaacaaacuguaaucccgaauaucggaucuagacccagaguaaggaauaucccuagcauaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaagcaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauaggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35191 - RNA, 1701 nt, Artificial Sequence
  hemagglutinin__InfluenzaA__ADG21020
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaagcggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucauagucucuaccaaaagaagccaacaaacuguaaccccgaauaucggaucuagaccuagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35192 - RNA, 1701 nt, Artificial Sequence
  hemagglutinin__InfluenzaA__ADG21022
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35193 - RNA, 1701 nt, Artificial Sequence
  hemagglutinin__InfluenzaA__ADG21023
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaaugugaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauauggguaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35194 - RNA, 1701 nt, Artificial Sequence
  hemagglutinin__InfluenzaA__ADG21024
augaagacuaucauugcuuuaagcuacauucuaugucugguuuucacucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcgcacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcagagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggcuugccaaaaaggcaacauuaggugcaacauuugcauuuga

SEQ ID NO: 35195 - RNA, 1701 nt, Artificial Sequence
  hemagglutinin__InfluenzaA__ADG21026
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaauaguuucuuuaguagauugaauugguugacccacuuaaacuucaaauacccagcauugaacgugacuaugccaaacaaugaacaauuugacaaauuguacauuugggggguucaccacccggguacggacaaggaccaaaucuuccuguaugcucaagcaucaggaagaaucacaguaucuaccaaaagaagccaacaagcuguaaucccgaauaucggaucuagacucagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaagcacucugaaauuggcaacaggaaugcgaaauguaccagagaaacaaacuagaggcauauuuggcgcaauagcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucacaauauaccacaaaugugacaaugccugcauaggaucaaucagaaauggaacuuaugaccacaauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35196 - RNA, 1701 nt, Artificial Sequence
  hemagglutinin__InfluenzaA__ADG21037
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35197 - RNA, 1701 nt, Artificial Sequence
  hemagglutinin__InfluenzaA__ADG21038
augaaggcaauacuaguaguucugcuauauacauuugcaaccgcagaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35198 - RNA, 1701 nt, Artificial Sequence
  hemagglutinin__InfluenzaA__ADG21040
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 35199 - RNA, 1701 nt, Artificial Sequence
  hemagglutinin__InfluenzaA__ADG21041
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcagucaguuucuggaugugcucuaaugggucucuacaguguagaauauguauuuaa

SEQ ID NO: 35200 - RNA, 1701 nt, Artificial Sequence
  hemagglutinin__InfluenzaA__ADG21042
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucuuuacaguguagaauauguauuuaa

SEQ ID NO: 35201 - RNA, 1701 nt, Artificial Sequence
  hemagglutinin__InfluenzaA__ADG21043
augaaggcaauacuaguaguucugcuauauacauuuacaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35202 - RNA, 1701 nt, Artificial Sequence
  hemagglutinin__InfluenzaA__ADG21045
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35203 - RNA, 1701 nt, Artificial Sequence; identical to SEQ ID NO: 35202
  hemagglutinin__InfluenzaA__ADG21046

SEQ ID NO: 35204 - RNA, 1701 nt, Artificial Sequence
  hemagglutinin__InfluenzaA__ADG21048
augaaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggcuugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35205 - RNA, 1701 nt, Artificial Sequence
  hemagglutinin__InfluenzaA__ADG21049
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacauccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35206 - RNA, 1701 nt, Artificial Sequence; identical to SEQ ID NO: 34264
  hemagglutinin__InfluenzaA__ADG21122

SEQ ID NO: 35207 - RNA, 1701 nt, Artificial Sequence
  hemagglutinin__InfluenzaA__ADG21123
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35208 - RNA, 1701 nt, Artificial Sequence
  hemagglutinin__InfluenzaA__ADG21124
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccccaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35209 - RNA, 1701 nt, Artificial Sequence
  hemagglutinin__InfluenzaA__ADG21125
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcgauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaacacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35210 - RNA, 1701 nt, Artificial Sequence
  hemagglutinin__InfluenzaA__ADG21126
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucgagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35211 - RNA, 1701 nt, Artificial Sequence; identical to SEQ ID NO: 35210
  hemagglutinin__InfluenzaA__ADG21127

SEQ ID NO: 35212 - RNA, 1701 nt, Artificial Sequence; identical to SEQ ID NO: 35210
  hemagglutinin__InfluenzaA__ADG21128

SEQ ID NO: 35213 - RNA, 1701 nt, Artificial Sequence; identical to SEQ ID NO: 35210
  hemagglutinin__InfluenzaA__ADG21129

SEQ ID NO: 35214 - RNA, 1701 nt, Artificial Sequence
  hemagglutinin__InfluenzaA__ADG21130
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 35215 - RNA, 1701 nt, Artificial Sequence
  hemagglutinin__InfluenzaA__ADG21131
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35216 - RNA, 1701 nt, Artificial Sequence; identical to SEQ ID NO: 35215
  hemagglutinin__InfluenzaA__ADG21132

SEQ ID NO: 35217 - RNA, 1701 nt, Artificial Sequence; identical to SEQ ID NO: 35215
  hemagglutinin__InfluenzaA__ADG21133

SEQ ID NO: 35218 - RNA, 1701 nt, Artificial Sequence; identical to SEQ ID NO: 35215
  hemagglutinin__InfluenzaA__ADG21134

SEQ ID NO: 35219 - RNA, 1701 nt, Artificial Sequence; identical to SEQ ID NO: 35215
  hemagglutinin__InfluenzaA__ADG21135

SEQ ID NO: 35220 - RNA, 1701 nt, Artificial Sequence; identical to SEQ ID NO: 35215
  hemagglutinin__InfluenzaA__ADG21136

SEQ ID NO: 35221 - RNA, 1701 nt, Artificial Sequence; identical to SEQ ID NO: 35215
  hemagglutinin__InfluenzaA__ADG21137

SEQ ID NO: 35222 - RNA, 1701 nt, Artificial Sequence
  hemagglutinin__InfluenzaA__ADG21138
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaucaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35223 - RNA, 1701 nt, Artificial Sequence
  hemagglutinin__InfluenzaA__ADG21139
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35224 - RNA, 1701 nt, Artificial Sequence
  hemagglutinin__InfluenzaA__ADG21140
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucaugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35225 - RNA, 1701 nt, Artificial Sequence; identical to SEQ ID NO: 34327
  hemagglutinin__InfluenzaA__ADG21141

SEQ ID NO: 35226 - RNA, 1701 nt, Artificial Sequence
  hemagglutinin__InfluenzaA__ADG21142
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagaaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35227 - RNA, 1701 nt, Artificial Sequence; identical to SEQ ID NO: 35215
  hemagglutinin__InfluenzaA__ADG21143

SEQ ID NO: 35228 - RNA, 1701 nt, Artificial Sequence; identical to SEQ ID NO: 35215
  hemagglutinin__InfluenzaA__ADG21144

SEQ ID NO: 35229 - RNA, 1701 nt, Artificial Sequence
  hemagglutinin__InfluenzaA__ADG21145
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuuagcauauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35230 - RNA, 1701 nt, Artificial Sequence; identical to SEQ ID NO: 35215
  hemagglutinin__InfluenzaA__ADG21146

SEQ ID NO: 35231 - RNA, 1701 nt, Artificial Sequence; identical to SEQ ID NO: 35215
  hemagglutinin__InfluenzaA__ADG21147

SEQ ID NO: 35232 - RNA, 1701 nt, Artificial Sequence
  hemagglutinin__InfluenzaA__ADG21148
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuguuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacagugcagaauauguauuuaa

SEQ ID NO: 35233 - RNA, 1701 nt, Artificial Sequence
  hemagglutinin__InfluenzaA__ADG21149
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuauccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35234 - RNA, 1701 nt, Artificial Sequence
  hemagglutinin__InfluenzaA__ADG21150
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguggagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35235 - RNA, 1701 nt, Artificial Sequence; identical to SEQ ID NO: 35215
  hemagglutinin__InfluenzaA__ADG21151

SEQ ID NO: 35236 - RNA, 1701 nt, Artificial Sequence; identical to SEQ ID NO: 35215
  hemagglutinin__InfluenzaA__ADG21152

SEQ ID NO: 35237 - RNA, 1701 nt, Artificial Sequence; identical to SEQ ID NO: 35214
  hemagglutinin__InfluenzaA__ADG21153

SEQ ID NO: 35238 - RNA, 1701 nt, Artificial Sequence; identical to SEQ ID NO: 35215
  hemagglutinin__InfluenzaA__ADG21154

SEQ ID NO: 35239 - RNA, 1701 nt, Artificial Sequence; identical to SEQ ID NO: 35215
  hemagglutinin__InfluenzaA__ADG21155

SEQ ID NO: 35240 - RNA, 1701 nt, Artificial Sequence; identical to SEQ ID NO: 35234
  hemagglutinin__InfluenzaA__ADG21156

SEQ ID NO: 35241 - RNA, 1701 nt, Artificial Sequence
  hemagglutinin__InfluenzaA__ADG21158
augaaggcaauacuaguaguucugcuauauacauuugcaaccgcaaaugcagacacauuauguauagguuaucaugcgaacaauucaacagacacuguagacacaguacuagaaaggaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35242 - RNA, 1701 nt, Artificial Sequence
  hemagglutinin__InfluenzaA__ADG21159
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcaauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugcuagucucccugggggcaaucaguuucuggaugugcucuaaugggucucuacaguguagaauauguauuuaa

SEQ ID NO: 35243 - RNA, 1701 nt, Artificial Sequence; identical to SEQ ID NO: 35241
  hemagglutinin__InfluenzaA__ADG21160

SEQ ID NO: 35244 - RNA, 1701 nt, Artificial Sequence
  hemagglutinin__InfluenzaA__ADG21161
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcugggucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacaauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35245 - RNA, 1701 nt, Artificial Sequence
  hemagglutinin__InfluenzaA__ADG21163
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuagacguuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35246 - RNA, 1701 nt, Artificial Sequence
  hemagglutinin__InfluenzaA__ADG21165
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuuaaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35247 - RNA, 1701 nt, Artificial Sequence; identical to SEQ ID NO: 34327
  hemagglutinin__InfluenzaA__ADG21166

SEQ ID NO: 35248 - RNA, 1701 nt, Artificial Sequence
  hemagglutinin__InfluenzaA__ADG21168
augaaggcaauacuaguaguucugcuauauacauuugcaaccgcgaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauucuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuucuuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35249 - RNA, 1701 nt, Artificial Sequence
  hemagglutinin__InfluenzaA__ADG21169
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauuggugcugguagucucccugggggcaaucaguuucuggaugugcucuaaugggucucuacaguguagaauauguauuuaa

SEQ ID NO: 35250 - RNA, 1701 nt, Artificial Sequence; identical to SEQ ID NO: 34327
  hemagglutinin__InfluenzaA__ADG21170

SEQ ID NO: 35251 - RNA, 1701 nt, Artificial Sequence; identical to SEQ ID NO: 34327
  hemagglutinin__InfluenzaA__ADG21173

SEQ ID NO: 35252 - RNA, 1701 nt, Artificial Sequence; identical to SEQ ID NO: 34270
  hemagglutinin__InfluenzaA__ADG21174

SEQ ID NO: 35253 - RNA, 1701 nt, Artificial Sequence; identical to SEQ ID NO: 34270
  hemagglutinin__InfluenzaA__ADG21175

SEQ ID NO: 35254 - RNA, 1701 nt, Artificial Sequence; identical to SEQ ID NO: 34327
  hemagglutinin__InfluenzaA__ADG21176

SEQ ID NO: 35255 - RNA, 1701 nt, Artificial Sequence; identical to SEQ ID NO: 34327
  hemagglutinin__InfluenzaA__ADG21177

SEQ ID NO: 35256 - RNA, 1701 nt, Artificial Sequence; identical to SEQ ID NO: 34327
  hemagglutinin__InfluenzaA__ADG21178

SEQ ID NO: 35257 - RNA, 1701 nt, Artificial Sequence; identical to SEQ ID NO: 34528
  hemagglutinin__InfluenzaA__ADG21179

SEQ ID NO: 35258 - RNA, 1701 nt, Artificial Sequence; identical to SEQ ID NO: 34327
  hemagglutinin__InfluenzaA__ADG21180

SEQ ID NO: 35259 - RNA, 1701 nt, Artificial Sequence; identical to SEQ ID NO: 34327
  hemagglutinin__InfluenzaA__ADG21181

SEQ ID NO: 35260 - RNA, 1701 nt, Artificial Sequence; identical to SEQ ID NO: 34327
  hemagglutinin__InfluenzaA__ADG21182

SEQ ID NO: 35261 - RNA, 1701 nt, Artificial Sequence; identical to SEQ ID NO: 34327
  hemagglutinin__InfluenzaA__ADG21183

SEQ ID NO: 35262 - RNA, 1701 nt, Artificial Sequence; identical to SEQ ID NO: 35234
  hemagglutinin__InfluenzaA__ADG21184

SEQ ID NO: 35263 - RNA, 1701 nt, Artificial Sequence
  hemagglutinin__InfluenzaA__ADG21185
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaagauguccaaaauauguaaaaagcacaaaauugagacuggccacaggauugaggaaugucccgucuauucaaucuagaggccuguuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35264 - RNA, 1701 nt, Artificial Sequence
  hemagglutinin__InfluenzaA__ADG21188
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35265 - RNA, 1707 nt, Artificial Sequence
  hemagglutinin__InfluenzaA__ADG21402
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggagugagcucagcauguccauaccagggaagauccuccuuuuuuagaaaugugguauggcuuaucaaaaaggacaaugcauacccaacaauaaagagaaguuacaauaauaccaaccaagaagaucuuuugguacugugggggauucaccauccgaaugaugcggcagagcagacaaggcucuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucaaacuccaauaggggcuauaaacuccaguaugccauuccacaacauccacccucucaccaucggggaaugccccaaauaugugaaaucaaacagauuaauccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacauaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35266 - RNA, 1704 nt, Artificial Sequence
  hemagglutinin__InfluenzaA__ADG21414
auggagaaaauagugcuucuucuugcaauagucaguauuguuaaaagugaucagauuugcauugguuaccaugcaaacaacucgacagagcauguugacacaauaauggaaaagaaugucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugauggggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaacggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuuugaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35267 - RNA, 1704 nt, Artificial Sequence
  hemagglutinin__InfluenzaA__ADG21416
auggagaaaauagugcuucuucuugcaauagucaguauuguuaaaagugaucagauuugcauugguuaccaugcaaacaacucaacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugcggcagagcagacagggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugauguaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccacagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguucuaucacagaugugauaaugaauguauggaaaguguaagaaacggaacguaugacuacccacaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35268 - RNA, 1704 nt, Artificial Sequence
  hemagglutinin__InfluenzaA__ADG21420
auggagaaaauagugcuucuucuugcaauagucaguauuguuaaaagugaucagauuugcauugguuaccaugcaaacaacucgacagagcagguugacacaauaauggaaaagaacgucacuguuacacaugcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcaauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35269 - RNA, 1704 nt, Artificial Sequence
  hemagglutinin__InfluenzaA__ADG21422
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaaugggaaacucugcaaucuagauggagugaagccucuaauuuuaagagauuguaguguagccggauggcuccucgggaauccaaugugcgacgaguuccucaaugugccggaauggucuuacauaguggaaaagaucaauccaaccaaugaccucuguuauccagggaauuucaacgacuaugaagaacugaaacaccuauugagcagaauaaaccauuuugagaaaauucagaucauccccaaaaauucuuggucagaucaugaagccucaggagugagcucagcauguccauaccagggaagauccuccuuuuuuagaaaugugguauggcuuaccaaaaagaacaaugcauacccaacaauaaagagaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacgggcaaaguggaaggauggaauucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaucuuuacgacaagguccggcuacagcuuagggauaaugcaaaagagcuugguaacgguuguuucgaguucuaucacagaugugauaaugaauguauggaaaguguaagaaacggaacguaugacuacccgcaguauucagaagaagcaagaucaaaaagagaggaaauaaguggggugaaauuggagucaauaggaacuuaccaaauacugucaauuuauucaacaguggcgagcucccuagcacuggcaaucaugguggcuggucuauuuuuauggaugugcuccaauggaucauuacaaugcagaauuugcauuuaa

SEQ ID NO: 35270 - RNA, 1704 nt, Artificial Sequence
  hemagglutinin__InfluenzaA__ADG21425
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagccggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauccccaaaaauucuuggucagaucauggagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugcggaagagcagacaaggcuuuaucaaaacccaacuaccuauauuuccguugggacaucaacacuaaaccagagauugguaccaaaaauagcuacuagaucuaagguaaacgggcaaaguggaaggauggaauucuuuuggacaauuuuaaaaucgaaugaugcaauaaacuuugagagcaauggaaauuucauugcuccagaaaaugcauacaaaauugucaagaaaggggacucaacaauuaugaaaagugaguuggaauaugauaacugcaacaccaagugucagacuccaauaggggcgauaaacuccaguaugccauuccacaacauccacccucucaccaucggggaaugccccaaauaugugaaaucaaacaaauuaguccuugcuacugggcucagaaauagcccucaaggagagaaaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaaugcuuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuuggcaacgguuguuucgaguucuaucacagaugugauaaugaauguauggaaaguguaagaaacggaacguaugacuacccgcaguauucagaagaagcaagauuaaaaagagaagaaauaaguggaguaaaauuggagucaauaggaacuuaccaaauauugucaauuuauucaacaguggcgagcucccuagcacuggcaaucaugguggcuggucuaucuuuauggauguguuccaauggaucguuacaaugcagaauuugcauuuaa

SEQ ID NO: 35271 - RNA, 1704 nt, Artificial Sequence
  hemagglutinin__InfluenzaA__ADG21429
auggagaaaauagugcuucuucuugcaauagucaguauuguuaaaagugaucagauuugcauugguuaccaugcaaacaacucaacagagcagguugacacaauaauggaaaagaacgucacuguuacacacgcccaagacauacuggaaaaaacacacaacgggaaacucugcaaucuagauggaguggagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugauguaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucagacagacuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcucgguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuacuuuuauggaugugcuccaauggaucguuacaaugcagaauuugcauuuaa

SEQ ID NO: 35272 - RNA, 1704 nt, Artificial Sequence
  hemagglutinin__InfluenzaA__ADG21437
auggagaaaauagugcuucuucuugcaauagucaguauuguuaaaagugaucagauuugcauugguuaccaugcaaacaacucaacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuacccaaaagaacaaugcauacccaacaauaaagaaaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccaaaaauagcuacuagaucuaaaguaaacgggcaaaguggaaggauggaguucuuuuggacaauuuuaaaaucgaaugauguaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaucauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguuuuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaaugggucguuacaaugcagaauuugcauuuaa

SEQ ID NO: 35273 - RNA, 1704 nt, Artificial Sequence
  hemagglutinin__InfluenzaA__ADG21439
auggagaaaauagugcuucuucuugcaauagucaguauuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccagccaaugaccucuguuauccagggaauuucaacgacuaugaagaacugaaacaccuauugagcagaauaaaccauuuugagaaaauucagaucauucccaaagguucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugcggcagagcagacaaggcuuuaucaaaacccaacuaccuauauuuccguugggacaucaacacuaaaccagagauugguaccccaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucgcuacaaugcagaauuugcauuuaa

SEQ ID NO: 35274 - RNA, 1704 nt, Artificial Sequence
  hemagglutinin__InfluenzaA__ADG21441
auggagaaaauagugcuucuucuugcaauagucaguauuguuaaaagugaucagauuugcauugguuaccaugcaaacaacucgacagagcaaguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccauccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugaggcagagcagacaagucuuuaucaaaacccaacuaccuauauuuccguugggacaucaacacuaaaccagagauugguaccaaaaauagcuacuagaucuaagguaaaugggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaauuggaauauggcaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggcggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguugcuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35275 - RNA, 1704 nt, Artificial Sequence
  hemagglutinin__InfluenzaA__ADG21443
auggagaaaauaguacuucuucuugcaauagucaguauuguuaaaagugaucagauuugcauugguuaccaugcaaacaacucgacagagcagguugacacaauaauggaaaagaacgucacuguuacacacgcccaagacauacuggaaaagacacacaacgggaaacucugcaaucuagauggagugaagccucuaauuuuaagagauuguaguguagcuggauggcuccuagggaacccaaugugcgacgaauuccucaaugugccggaauggucuuacauaguggagaagaucaauccaaccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguauuaugggggauucaccauccaaaugaugcggcagagcagacaaggcuuuaucaaaacccaacuaccuauauuuccguugggacaucaacacuaaaccagagauugguacccaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaguuggaauaugguaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguugggagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguucuaucacagaugugauaaugaauguauggaaaguguaagaaacgguacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucgcuacaaugcagaauuugcauuuaa

SEQ ID NO: 35276 - RNA, 1704 nt, Artificial Sequence
  hemagglutinin__InfluenzaA__ADG21445
auggagaaaauagugcuucuucuugcaauagucaguauuguuaaaagugaucagauuugcauugguuaccaugcaaacaacucgacagagcaaguugacacaauaauggaaaagaacgucacuguuacacacgcccaagacauacuggaaaagacacacaacgggaaacucugcaaucuagauggagugaagccucuaauuuuaagagauuguaguguagcuggauggcuccucgggaacccaaugugcgacgaauuccucaaugugccggaauggucuuacauaguggagaagaucaauccauccaaugaccucuguuauccagggaauuucaacgacuaugaagaacugaaacaccuauugagcagaauaaaccauuuugagaaaauucagaucauucccaaaaauucuuggucagaucaugaagccucaggagugagcucagcauguccauaccagggaagauccuccuuuuuuagaaaugugguauggcuuaccaaaaagaacaaugcauacccaacaauaaagaaaaguuacaauaauaccaaccaagaagaucuuuugguacuaugggggauucaccauccaaaugaugaggcagagcagacaaggcuuuaucaaaacccaacuaccuauauuuccguugggacaucaacacuaaaccagagauugguaccaaaaauagcuacuagaucuaagguaaacgggcaaaguggaaggauggaguucuuuuggacaauuuuaaaaucgaaugaugcaauaaacuuugagaguaauggaaauuucauugcuccagaaaaugcauacaaaauugucaagaaaggggacucaacaauuaugaaaagugaauuggaauauggcaacugcaacaccaagugucagacuccaauaggggcgauaaacuccaguaugccauuccacaacauccacccucucaccaucggggaaugccccaaauaugugaaaucaaacagauuaguccuugcuacugggcucagaaauagcccucaaggagagagaagaagaaaaaagagaggacuauuuggagcuauagcagguuuuauagagggcggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuaugacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggagucaauaggaacuuaccaaauacugucaauuuauucaacaguggcgagcucccuagcacuggcaaucaugguggcuggucuauuuuuauggaugugcuccaauggaucguuacaaugcagaauuugcauuuaa

SEQ ID NO: 35277 - RNA, 1701 nt, Artificial Sequence
  hemagglutinin__InfluenzaA__ADG21912
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35278 - RNA, 1701 nt, Artificial Sequence
  hemagglutinin__InfluenzaA__ADG21913
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35279 - RNA, 1701 nt, Artificial Sequence
  hemagglutinin__InfluenzaA__ADG21914
augaaggcaauaauaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcgauaaacaccagccuaccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35280 - RNA, 1701 nt, Artificial Sequence
  hemagglutinin__InfluenzaA__ADG21915
auggaggcaauacuaguaguucugcuauauacauuugcaaccgcaaaugcagacacauuauguauagguuaucaugcgaacaauucaacagacacuguagacacaguacuagaaaagaaugugacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauagaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugagaaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35281 - RNA, 1701 nt, Artificial Sequence
  hemagglutinin__InfluenzaA__ADG21916
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35282 - RNA, 1701 nt, Artificial Sequence
  hemagglutinin__InfluenzaA__ADG21917
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucugugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35283 - RNA, 1701 nt, Artificial Sequence; identical to SEQ ID NO: 34673
  hemagglutinin__InfluenzaA__ADG21918

SEQ ID NO: 35284 - RNA, 1701 nt, Artificial Sequence
  hemagglutinin__InfluenzaA__ADG21919
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguaaccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35285 - RNA, 1701 nt, Artificial Sequence
  hemagglutinin__InfluenzaA__ADG21921
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuga

SEQ ID NO: 35286 - RNA, 1701 nt, Artificial Sequence
  hemagglutinin__InfluenzaA__ADG21922
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucagcuucuggaugugcucuaaugggucucuacaguguagaauauguauuuaa

SEQ ID NO: 35287 - RNA, 1701 nt, Artificial Sequence
  hemagglutinin__InfluenzaA__ADG21923
augaaggcaauacuaguaguucugcuauauacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35288 - RNA, 1701 nt, Artificial Sequence
  hemagglutinin__InfluenzaA__ADG21924
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaaacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35289 - RNA, 1701 nt, Artificial Sequence
  hemagglutinin__InfluenzaA__ADG21925
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35290 - RNA, 1701 nt, Artificial Sequence
  hemagglutinin__InfluenzaA__ADG21926
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaaguaagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaauuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35291 - RNA, 1701 nt, Artificial Sequence; identical to SEQ ID NO: 35277
  hemagglutinin__InfluenzaA__ADG21927

SEQ ID NO: 35292 - RNA, 1701 nt, Artificial Sequence
  hemagglutinin__InfluenzaA__ADG21928
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccagagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35293 - RNA, 1701 nt, Artificial Sequence; identical to SEQ ID NO: 35289
  hemagglutinin__InfluenzaA__ADG21930

SEQ ID NO: 35294 - RNA, 1701 nt, Artificial Sequence; identical to SEQ ID NO: 35277
  hemagglutinin__InfluenzaA__ADG21931

SEQ ID NO: 35295 - RNA, 1701 nt, Artificial Sequence
  hemagglutinin__InfluenzaA__ADG21932
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35296 - RNA, 1701 nt, Artificial Sequence; identical to SEQ ID NO: 35277
  hemagglutinin__InfluenzaA__ADG21933

SEQ ID NO: 35297 - RNA, 1701 nt, Artificial Sequence; identical to SEQ ID NO: 35289
  hemagglutinin__InfluenzaA__ADG21934

SEQ ID NO: 35298 - RNA, 1701 nt, Artificial Sequence
  hemagglutinin__InfluenzaA__ADG21935
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaaauugucagacacccaauggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35299 - RNA, 1701 nt, Artificial Sequence; identical to SEQ ID NO: 35295
  hemagglutinin__InfluenzaA__ADG21936

SEQ ID NO: 35300 - RNA, 1701 nt, Artificial Sequence; identical to SEQ ID NO: 35295
  hemagglutinin__InfluenzaA__ADG21937

SEQ ID NO: 35301 - RNA, 1701 nt, Artificial Sequence
  hemagglutinin__InfluenzaA__ADG21938
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaaauuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35302 - RNA, 1701 nt, Artificial Sequence; identical to SEQ ID NO: 35277
  hemagglutinin__InfluenzaA__ADG21939

SEQ ID NO: 35303 - RNA, 1701 nt, Artificial Sequence; identical to SEQ ID NO: 35281
  hemagglutinin__InfluenzaA__ADG21940

SEQ ID NO: 35304 - RNA, 1701 nt, Artificial Sequence
  hemagglutinin__InfluenzaA__ADG21941
auggaggcaauacuaguaguucugcuauauacauucgcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35305 - RNA, 1701 nt, Artificial Sequence
  hemagglutinin__InfluenzaA__ADG21943
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacaugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35306 - RNA, 1701 nt, Artificial Sequence
  hemagglutinin__InfluenzaA__ADG21944
auggaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35307 - RNA, 1701 nt, Artificial Sequence; identical to SEQ ID NO: 35277
  hemagglutinin__InfluenzaA__ADG21945

SEQ ID NO: 35308 - RNA, 1701 nt, Artificial Sequence; identical to SEQ ID NO: 35295
  hemagglutinin__InfluenzaA__ADG21946

SEQ ID NO: 35309 - RNA, 1701 nt, Artificial Sequence; identical to SEQ ID NO: 35277
  hemagglutinin__InfluenzaA__ADG21947

SEQ ID NO: 35310 - RNA, 1701 nt, Artificial Sequence
  hemagglutinin__InfluenzaA__ADG21948
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggaccaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35311 - RNA, 1701 nt, Artificial Sequence
  hemagglutinin__InfluenzaA__ADG27794
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggacuuaccagauuuuggcgaucuauucaacugucgccaguucauugguacugguagucucccugggggcaaucaguuucuggauguguucuaaugggucucuacaguguagaauauguauuuaa

SEQ ID NO: 35312 - RNA, 1701 nt, Artificial Sequence; identical to SEQ ID NO: 33168
  hemagglutinin__InfluenzaA__ADG27948

SEQ ID NO: 35313 - RNA, 1701 nt, Artificial Sequence; identical to SEQ ID NO: 33168
  hemagglutinin__InfluenzaA__ADG27966

SEQ ID NO: 35314 - RNA, 1701 nt, Artificial Sequence
  hemagglutinin__InfluenzaA__ADG27974
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaaggcccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugauacugguagucucccugggggcaaucaguuucuggaugugcucuaaugggucucuacaguguagaauauguauuuaa

SEQ ID NO: 35315 - RNA, 1701 nt, Artificial Sequence
  hemagglutinin__InfluenzaA__ADG27982
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35316 - RNA, 1701 nt, Artificial Sequence
  hemagglutinin__InfluenzaA__ADG27988
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugccauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35317 - RNA, 1701 nt, Artificial Sequence; identical to SEQ ID NO: 33168
  hemagglutinin__InfluenzaA__ADG27997

SEQ ID NO: 35318 - RNA, 1701 nt, Artificial Sequence; identical to SEQ ID NO: 33168
  hemagglutinin__InfluenzaA__ADG28011

SEQ ID NO: 35319 - RNA, 1701 nt, Artificial Sequence; identical to SEQ ID NO: 34731
  hemagglutinin__InfluenzaA__ADG42093

SEQ ID NO: 35320 - RNA, 1701 nt, Artificial Sequence; identical to SEQ ID NO: 34337
  hemagglutinin__InfluenzaA__ADG42103

SEQ ID NO: 35321 - RNA, 1701 nt, Artificial Sequence
  hemagglutinin__InfluenzaA__ADG42113
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucuuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaagaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35322 - RNA, 1701 nt, Artificial Sequence; identical to SEQ ID NO: 35118
  hemagglutinin__InfluenzaA__ADG42123

SEQ ID NO: 35323 - RNA, 1701 nt, Artificial Sequence
  hemagglutinin__InfluenzaA__ADG42133
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuuaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggucacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35324 - RNA, 1701 nt, Artificial Sequence
  hemagglutinin__InfluenzaA__ADG42143
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaaaaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaacuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35325 - RNA, 1701 nt, Artificial Sequence
  hemagglutinin__InfluenzaA__ADG42153
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccugagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccucgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35326 - RNA, 1701 nt, Artificial Sequence
  hemagglutinin__InfluenzaA__ADG42193
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35327 - RNA, 1701 nt, Artificial Sequence
  hemagglutinin__InfluenzaA__ADG42213
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35328 - RNA, 1701 nt, Artificial Sequence; identical to SEQ ID NO: 33173
  hemagglutinin__InfluenzaA__ADG42233

SEQ ID NO: 35329 - RNA, 1701 nt, Artificial Sequence
  hemagglutinin__InfluenzaA__ADG42243
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccucgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35330 - RNA, 1701 nt, Artificial Sequence
  hemagglutinin__InfluenzaA__ADG42253
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35331 - RNA, 1701 nt, Artificial Sequence; identical to SEQ ID NO: 33206
  hemagglutinin__InfluenzaA__ADG42263

SEQ ID NO: 35332 - RNA, 1701 nt, Artificial Sequence; identical to SEQ ID NO: 34819
  hemagglutinin__InfluenzaA__ADG42273

SEQ ID NO: 35333 - RNA, 1701 nt, Artificial Sequence
  hemagglutinin__InfluenzaA__ADG42283
augaaggcaauacuaguaguucugcuauauacauuugcaaccgcaaaugcagacacauuauguauagguuaucaugcgaacaauucaacagacacuguagacacaguauuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaggauauguauuuaa

SEQ ID NO: 35334 - RNA, 1701 nt, Artificial Sequence
  hemagglutinin__InfluenzaA__ADG42293
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaccgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaaaaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35335 - RNA, 1701 nt, Artificial Sequence
  hemagglutinin__InfluenzaA__ADG42303
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguaguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35336 - RNA, 1701 nt, Artificial Sequence
  hemagglutinin__InfluenzaA__ADG42313
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35337 - RNA, 1701 nt, Artificial Sequence
  hemagglutinin__InfluenzaA__ADG42323
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35338 - RNA, 1701 nt, Artificial Sequence
  hemagglutinin__InfluenzaA__ADG42333
augaaggcaauacuaguaguucugcuauauacacuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagaugcaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35339 - RNA, 1701 nt, Artificial Sequence
  hemagglutinin__InfluenzaA__ADG42343
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuuuggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaaguaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuagccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35340 - RNA, 1701 nt, Artificial Sequence
  hemagglutinin__InfluenzaA__ADG42363
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35341 - RNA, 1701 nt, Artificial Sequence
  hemagglutinin__InfluenzaA__ADG42373
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaucuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35342 - RNA, 1701 nt, Artificial Sequence
  hemagglutinin__InfluenzaA__ADG42393
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgagaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuguuagucucccugggggcaaucaguuucuggaugugcucuaaugggucucuacaguguagaauauguauuuaa

SEQ ID NO: 35343 - RNA, 1701 nt, Artificial Sequence
  hemagglutinin__InfluenzaA__ADG42403
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35344 - RNA, 1701 nt, Artificial Sequence
  hemagglutinin__InfluenzaA__ADG42413
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35345 - RNA, 1701 nt, Artificial Sequence
  hemagglutinin__InfluenzaA__ADG42423
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgauuuauucaacugucgccaguucauugguacugguagucucccugggggcaaucaguuucuggaugugcucuaaugggucucuacaguguagaauauguauuuaa

SEQ ID NO: 35346 - RNA, 1701 nt, Artificial Sequence
  hemagglutinin__InfluenzaA__ADG42443
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35347 - RNA, 1701 nt, Artificial Sequence
  hemagglutinin__InfluenzaA__ADG42453
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaguagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucuuugguacugguagucucccugggggcaaucaguuucuggaugugcucuaaugggucucuacaguguagaauauguauuuaa

SEQ ID NO: 35348 - RNA, 1701 nt, Artificial Sequence
  hemagglutinin__InfluenzaA__ADG42463
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35349 - RNA, 1701 nt, Artificial Sequence
  hemagglutinin__InfluenzaA__ADG42473
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35350 - RNA, 1701 nt, Artificial Sequence
  hemagglutinin__InfluenzaA__ADG42483
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35351 - RNA, 1701 nt, Artificial Sequence
  hemagglutinin__InfluenzaA__ADG42493
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35352 - RNA, 1701 nt, Artificial Sequence
  hemagglutinin__InfluenzaA__ADG42503
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauuacauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35353 - RNA, 1701 nt, Artificial Sequence
  hemagglutinin__InfluenzaA__ADG42513
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacgcagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35354 - RNA, 1701 nt, Artificial Sequence
  hemagglutinin__InfluenzaA__ADG42533
augaaggcaauacuaguaguucugcuauauacauuugcaaccgcaaaagcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggagauagcaauaagacccaaagugagggaccaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35355 - RNA, 1701 nt, Artificial Sequence
  hemagglutinin__InfluenzaA__ADG42553
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguucucaugcuggagcaaaaagcuucuacaaaaauuuaauauggcuaguuaaaaaaggaaauucauacccaaagcucaacaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccaucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauacgaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35356 - RNA, 1701 nt, Artificial Sequence
  hemagglutinin__InfluenzaA__ADG42573
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaauagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacaaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35357 - RNA, 1701 nt, Artificial Sequence
  hemagglutinin__InfluenzaA__ADG42583
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35358 - RNA, 1701 nt, Artificial Sequence
  hemagglutinin__InfluenzaA__ADG42593
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35359 - RNA, 1701 nt, Artificial Sequence
  hemagglutinin__InfluenzaA__ADG42603
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagaaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaacaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaggguucuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35360 - RNA, 1701 nt, Artificial Sequence
  hemagglutinin__InfluenzaA__ADG42613
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35361 - RNA, 1701 nt, Artificial Sequence; identical to SEQ ID NO: 34846
  hemagglutinin__InfluenzaA__ADG42623

SEQ ID NO: 35362 - RNA, 1701 nt, Artificial Sequence
  hemagglutinin__InfluenzaA__ADG42633
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35363 - RNA, 1701 nt, Artificial Sequence
  hemagglutinin__InfluenzaA__ADG42643
augaaggcaauacuaguaguucugcuauauacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagaggggcagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacguuaaugauaaagggaaagaaguccucguacuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35364 - RNA, 1701 nt, Artificial Sequence
  hemagglutinin__InfluenzaA__ADG42653
augaaggcaauacuaguaguucugcuauauacaucugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35365 - RNA, 1701 nt, Artificial Sequence
  hemagglutinin__InfluenzaA__ADG42663
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35366 - RNA, 1701 nt, Artificial Sequence
  hemagglutinin__InfluenzaA__ADG42673
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaaaagggguagccccauugcauuuggguaaauguaacauugcuggcuggauccugggaaauccagagugugaaucacucuccacagcaggcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35367 - RNA, 1701 nt, Artificial Sequence
  hemagglutinin__InfluenzaA__ADG42683
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccagggaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35368 - RNA, 1701 nt, Artificial Sequence
  hemagglutinin__InfluenzaA__ADG42693
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacaucuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaacuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35369 - RNA, 1701 nt, Artificial Sequence
  hemagglutinin__InfluenzaA__ADG42703
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35370 - RNA, 1701 nt, Artificial Sequence
  hemagglutinin__InfluenzaA__ADG42723
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagacuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauggcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35371 - RNA, 1701 nt, Artificial Sequence; identical to SEQ ID NO: 34846
  hemagglutinin__InfluenzaA__ADG42743

SEQ ID NO: 35372 - RNA, 1701 nt, Artificial Sequence
  hemagglutinin__InfluenzaA__ADG42753
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauucuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35373 - RNA, 1701 nt, Artificial Sequence
  hemagglutinin__InfluenzaA__ADG42763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaaccucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucuggcauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35374 - RNA, 1701 nt, Artificial Sequence
  hemagglutinin__InfluenzaA__ADG42773
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35375 - RNA, 1701 nt, Artificial Sequence
  hemagglutinin__InfluenzaA__ADG42783
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucgagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacuugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35376 - RNA, 1701 nt, Artificial Sequence; identical to SEQ ID NO: 35374
  hemagglutinin__InfluenzaA__ADG42793

SEQ ID NO: 35377 - RNA, 1701 nt, Artificial Sequence; identical to SEQ ID NO: 35375
  hemagglutinin__InfluenzaA__ADG42803

SEQ ID NO: 35378 - RNA, 1701 nt, Artificial Sequence
  hemagglutinin__InfluenzaA__ADG42813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccuucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35379 - RNA, 1701 nt, Artificial Sequence; identical to SEQ ID NO: 34868
  hemagglutinin__InfluenzaA__ADG42823

SEQ ID NO: 35380 - RNA, 1701 nt, Artificial Sequence
  hemagglutinin__InfluenzaA__ADG42833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgaaauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcuguuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35381 - RNA, 1701 nt, Artificial Sequence; identical to SEQ ID NO: 34876
  hemagglutinin__InfluenzaA__ADG42843

SEQ ID NO: 35382 - RNA, 1701 nt, Artificial Sequence; identical to SEQ ID NO: 34953
  hemagglutinin__InfluenzaA__ADG42853

SEQ ID NO: 35383 - RNA, 1701 nt, Artificial Sequence; identical to SEQ ID NO: 34891
  hemagglutinin__InfluenzaA__ADG42863

SEQ ID NO: 35384 - RNA, 1701 nt, Artificial Sequence; identical to SEQ ID NO: 34911
  hemagglutinin__InfluenzaA__ADG42883

SEQ ID NO: 35385 - RNA, 1701 nt, Artificial Sequence
  hemagglutinin__InfluenzaA__ADG42893
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaauuugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35386 - RNA, 1701 nt, Artificial Sequence
  hemagglutinin__InfluenzaA__ADG42903
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35387 - RNA, 1701 nt, Artificial Sequence; identical to SEQ ID NO: 34875
  hemagglutinin__InfluenzaA__ADG42913

SEQ ID NO: 35388 - RNA, 1701 nt, Artificial Sequence
  hemagglutinin__InfluenzaA__ADG42923
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35389 - RNA, 1701 nt, Artificial Sequence
  hemagglutinin__InfluenzaA__ADG57087
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccauuucauugguacugguagucucccugggggcaaucaguuucuggaugugcucuaaugggucucuacgguguagaauauguauuuaa

SEQ ID NO: 35390 - RNA, 1701 nt, Artificial Sequence; identical to SEQ ID NO: 33173
  hemagglutinin__InfluenzaA__ADG57088

SEQ ID NO: 35391 - RNA, 1701 nt, Artificial Sequence
  hemagglutinin__InfluenzaA__ADG57089
auggaggcaauacuaguaguucugcuauauacauuugcaaccgcaaacgcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauccaguaugaggagcugagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccgaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35392 - RNA, 1701 nt, Artificial Sequence
  hemagglutinin__InfluenzaA__ADG57090
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaaguaucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaggaguucaaccaccuggaaaaaagaauagagaauuuaaauaaaaaaguugaugaugguuuccuggacauuuggacuuacaaugcccaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacuccgaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35393 - RNA, 1701 nt, Artificial Sequence
  hemagglutinin__InfluenzaA__ADG57091
auggaggcaauacuaguaguucugcuauauacauuugcaaccgcaaaugcagacacauuauguauagguuaucaugcgaacaauucaacagacacuguagacacaguacuagaaaagaauguaacaguaacacacucugucaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaaaggggguggacagggaugguagauggaugguacgguuaucaccaucaaaaugagcaggggucaggauaugcagccgaccugaagagcacacagaacgccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35394 - RNA, 1701 nt, Artificial Sequence
  hemagglutinin__InfluenzaA__ADG57092
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaucaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35395 - RNA, 1701 nt, Artificial Sequence
  hemagglutinin__InfluenzaA__ADG57093
auggaggcaauacuaguaguucugcuauauacauuugcaaccgcaaacgcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguguggucaucaagauacagcaagaaguucaagccggaaauagcaauaagacccaaagugagggaucaagaagggagaaugaacuauuacuggacacuaguagagccgggagacaaaauaacauucgaagcaacuggaaaucuacugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuaucgaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35396 - RNA, 1701 nt, Artificial Sequence
  hemagglutinin__InfluenzaA__ADG57094
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacaguaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35397 - RNA, 1701 nt, Artificial Sequence; identical to SEQ ID NO: 33801
  hemagglutinin__InfluenzaA__ADG57095

SEQ ID NO: 35398 - RNA, 1701 nt, Artificial Sequence
  hemagglutinin__InfluenzaA__ADG57097
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguaaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaaggauagagaauuuaaauaaaaaaguugaugaugguuuccuggacauuuggacuuacaaugccgaacuguugguucuauuggaaaaugaaagaacuuuggauuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35399 - RNA, 1701 nt, Artificial Sequence
  hemagglutinin__InfluenzaA__ADG57098
augaaggcaauacuaguaguucugcuauauacauuugcaaccgcaaaugcagacacauuauguauagguuaucaugcgaacaauucaacagacacuguagacacaguacuagagaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcugaccugaagagcacacagaaugccauugacaagauuacuaacaaaguaaacucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35400 - RNA, 1701 nt, Artificial Sequence
  hemagglutinin__InfluenzaA__ADG57099
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaaacucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuaucacuggacacuaguagagccgggagacaaaauaacauucgaagcaacuggaaaucuagugguaccgagauaugcauucgcaauggaaagaaaugcuggaucugguauuaucauuacagauacaccaguccacgauugcaauacaacuugucagacacccaagggugcuguaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaacucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35401 - RNA, 1701 nt, Artificial Sequence
  hemagglutinin__InfluenzaA__ADG57100
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaggagguaaagaguucaaccaccuggaaaaaagaauagagaauuuaaauaaaaagguugaugaugguuuccuggacauuuggacuuacaaugccgaacuguugguucuauuggaaaaugaaaggacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35402 - RNA, 1701 nt, Artificial Sequence; identical to SEQ ID NO: 34755
  hemagglutinin__InfluenzaA__ADG58939

SEQ ID NO: 35403 - RNA, 1701 nt, Artificial Sequence
  hemagglutinin__InfluenzaA__ADG58940
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35404 - RNA, 1701 nt, Artificial Sequence
  hemagglutinin__InfluenzaA__ADG58941
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguaugguuaucaccaugaaaaugagcaggggucaggauacgcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35405 - RNA, 1701 nt, Artificial Sequence
  hemagglutinin__InfluenzaA__ADG58942
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucuccaucaaaaugagcaggggucaggauacgcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35406 - RNA, 1701 nt, Artificial Sequence; identical to SEQ ID NO: 34755
  hemagglutinin__InfluenzaA__ADG58943

SEQ ID NO: 35407 - RNA, 1701 nt, Artificial Sequence
  hemagglutinin__InfluenzaA__ADG58944
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35408 - RNA, 1701 nt, Artificial Sequence; identical to SEQ ID NO: 33971
  hemagglutinin__InfluenzaA__ADG58946

SEQ ID NO: 35409 - RNA, 1701 nt, Artificial Sequence; identical to SEQ ID NO: 34755
  hemagglutinin__InfluenzaA__ADG58947

SEQ ID NO: 35410 - RNA, 1701 nt, Artificial Sequence
  hemagglutinin__InfluenzaA__ADG58948
augaaggcaauacuaauaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauacgcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35411 - RNA, 1701 nt, Artificial Sequence
  hemagglutinin__InfluenzaA__ADG58949
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaucaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauacgcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35412 - RNA, 1701 nt, Artificial Sequence
  hemagglutinin__InfluenzaA__ADG58951
augaaggcaauacuaguaguucugcuacauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucaggcaauggaacguguuacccaggagaguucauagauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauagaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35413 - RNA, 1701 nt, Artificial Sequence; identical to SEQ ID NO: 35412
  hemagglutinin__InfluenzaA__ADG58952

SEQ ID NO: 35414 - RNA, 1701 nt, Artificial Sequence; identical to SEQ ID NO: 35412
  hemagglutinin__InfluenzaA__ADG58953

SEQ ID NO: 35415 - RNA, 1701 nt, Artificial Sequence; identical to SEQ ID NO: 35412
  hemagglutinin__InfluenzaA__ADG58954

SEQ ID NO: 35416 - RNA, 1701 nt, Artificial Sequence; identical to SEQ ID NO: 35412
  hemagglutinin__InfluenzaA__ADG58955

SEQ ID NO: 35417 - RNA, 1701 nt, Artificial Sequence; identical to SEQ ID NO: 35412
  hemagglutinin__InfluenzaA__ADG58956

SEQ ID NO: 35418 - RNA, 1701 nt, Artificial Sequence
  hemagglutinin__InfluenzaA__ADG58957
augaaggcaauacuaguaguucugcuacauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaauucaggcaauggaacguguuacccaggagaguucauagauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaauagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35419 - RNA, 1701 nt, Artificial Sequence
  hemagglutinin__InfluenzaA__ADG58959
augaaggcaauacuaguaguucugcuauauacauuugcaaccgcaaaugcagacacauuauguauagguuaucaugcaaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaucuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaauagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35420 - RNA, 1701 nt, Artificial Sequence
  hemagglutinin__InfluenzaA__ADG58960
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaaccugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35421 - RNA, 1701 nt, Artificial Sequence; identical to SEQ ID NO: 35420
  hemagglutinin__InfluenzaA__ADG58961

SEQ ID NO: 35422 - RNA, 1701 nt, Artificial Sequence; identical to SEQ ID NO: 35420
  hemagglutinin__InfluenzaA__ADG58962

SEQ ID NO: 35423 - RNA, 1701 nt, Artificial Sequence; identical to SEQ ID NO: 35420
  hemagglutinin__InfluenzaA__ADG58963

SEQ ID NO: 35424 - RNA, 1701 nt, Artificial Sequence; identical to SEQ ID NO: 35420
  hemagglutinin__InfluenzaA__ADG58964

SEQ ID NO: 35425 - RNA, 1701 nt, Artificial Sequence
  hemagglutinin__InfluenzaA__ADG58965
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacauguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccauccacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaaccugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuauaugaaaagguaagaagccaguuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35426 - RNA, 1701 nt, Artificial Sequence; identical to SEQ ID NO: 35420
  hemagglutinin__InfluenzaA__ADG58966

SEQ ID NO: 35427 - RNA, 1701 nt, Artificial Sequence; identical to SEQ ID NO: 35420
  hemagglutinin__InfluenzaA__ADG58967

SEQ ID NO: 35428 - RNA, 1701 nt, Artificial Sequence; identical to SEQ ID NO: 35420
  hemagglutinin__InfluenzaA__ADG58968

SEQ ID NO: 35429 - RNA, 1701 nt, Artificial Sequence
  hemagglutinin__InfluenzaA__ADG59628
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35430 - RNA, 1701 nt, Artificial Sequence; identical to SEQ ID NO: 35429
  hemagglutinin__InfluenzaA__ADG59629

SEQ ID NO: 35431 - RNA, 1701 nt, Artificial Sequence
  hemagglutinin__InfluenzaA__ADG59630
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35432 - RNA, 1701 nt, Artificial Sequence; identical to SEQ ID NO: 35431
  hemagglutinin__InfluenzaA__ADG59631

SEQ ID NO: 35433 - RNA, 1701 nt, Artificial Sequence; identical to SEQ ID NO: 35431
  hemagglutinin__InfluenzaA__ADG59632

SEQ ID NO: 35434 - RNA, 1701 nt, Artificial Sequence
  hemagglutinin__InfluenzaA__ADG59633
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35435 - RNA, 1701 nt, Artificial Sequence
  hemagglutinin__InfluenzaA__ADG59634
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35436 - RNA, 1701 nt, Artificial Sequence
  hemagglutinin__InfluenzaA__ADG59635
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35437 - RNA, 1701 nt, Artificial Sequence
  hemagglutinin__InfluenzaA__ADG59636
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35438 - RNA, 1701 nt, Artificial Sequence
  hemagglutinin__InfluenzaA__ADG59638
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35439 - RNA, 1701 nt, Artificial Sequence
  hemagglutinin__InfluenzaA__ADG59639
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35440 - RNA, 1701 nt, Artificial Sequence
  hemagglutinin__InfluenzaA__ADG59641
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaguguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35441 - RNA, 1701 nt, Artificial Sequence
  hemagglutinin__InfluenzaA__ADG59643
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucgacugucgccaguucauugguacugguagucucccugggggcaaucaguuucuggaugugcuccaaugggucucuacaguguagaauauguauuuaa

SEQ ID NO: 35442 - RNA, 1701 nt, Artificial Sequence
  hemagglutinin__InfluenzaA__ADG59644
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguuaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35443 - RNA, 1701 nt, Artificial Sequence; identical to SEQ ID NO: 35431
  hemagglutinin__InfluenzaA__ADG59646

SEQ ID NO: 35444 - RNA, 1701 nt, Artificial Sequence
  hemagglutinin__InfluenzaA__ADG59647
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35445 - RNA, 1701 nt, Artificial Sequence
  hemagglutinin__InfluenzaA__ADG59648
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35446 - RNA, 1701 nt, Artificial Sequence; identical to SEQ ID NO: 35445
  hemagglutinin__InfluenzaA__ADG59649

SEQ ID NO: 35447 - RNA, 1701 nt, Artificial Sequence; identical to SEQ ID NO: 35445
  hemagglutinin__InfluenzaA__ADG59650

SEQ ID NO: 35448 - RNA, 1701 nt, Artificial Sequence; identical to SEQ ID NO: 35445
  hemagglutinin__InfluenzaA__ADG59651

SEQ ID NO: 35449 - RNA, 1701 nt, Artificial Sequence
  hemagglutinin__InfluenzaA__ADG59652
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35450 - RNA, 1701 nt, Artificial Sequence
  hemagglutinin__InfluenzaA__ADG59653
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35451 - RNA, 1701 nt, Artificial Sequence
  hemagglutinin__InfluenzaA__ADG59655
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35452 - RNA, 1701 nt, Artificial Sequence
  hemagglutinin__InfluenzaA__ADG59656
augaaggcaauacuaguaguucugcuauauacauuugcaaccgcaaaugcggacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuaugggggauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35453 - RNA, 1701 nt, Artificial Sequence
  hemagglutinin__InfluenzaA__ADG59657
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaagaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuacucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35454 - RNA, 1701 nt, Artificial Sequence
  hemagglutinin__InfluenzaA__ADG59658
augaaggcaauacuaguaguucugcuauauacauuugcaaccgcaaaugcagacacauuguguauagguuaucaugcgaacaauucaacagacacuauagacacaguacuagaaaagaauguaacaguaacacacucuguuaaccuucuagaagacaagcauaacgggaaacuaugcaaacuaagagggguagccccacugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35455 - RNA, 1701 nt, Artificial Sequence
  hemagglutinin__InfluenzaA__ADG59659
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35456 - RNA, 1701 nt, Artificial Sequence; identical to SEQ ID NO: 35455
  hemagglutinin__InfluenzaA__ADG59660

SEQ ID NO: 35457 - RNA, 1701 nt, Artificial Sequence
  hemagglutinin__InfluenzaA__ADG59662
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35458 - RNA, 1701 nt, Artificial Sequence
  hemagglutinin__InfluenzaA__ADG59663
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguguuuguggggacaucaagauacagcaagaaguucaagccggaaauagcaauaagacccaaagugagggaucaagaagggagaaugaacuauuacuggacacuaguagaaccgggggacaaaauaacauucgaagcaacuggaaaucuagugguaccgagauaugcauucgcaauggaaagaaaugcuggaucugguauuaucauuucagauacaccauuccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35459 - RNA, 1701 nt, Artificial Sequence
  hemagglutinin__InfluenzaA__ADG59664
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauccaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35460 - RNA, 1701 nt, Artificial Sequence
  hemagglutinin__InfluenzaA__ADG59666
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucagcugucgccaguucauugguacugguagucucccugggggcaaucaguuucuggaugugcuccaaugggucucuacaguguagaauauguauuuaa

SEQ ID NO: 35461 - RNA, 1701 nt, Artificial Sequence
  hemagglutinin__InfluenzaA__ADG59667
augaaggcaauacuaguaguucugcuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauugagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35462 - RNA, 1701 nt, Artificial Sequence
  hemagglutinin__InfluenzaA__ADG59669
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagauccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggauggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35463 - RNA, 1701 nt, Artificial Sequence; identical to SEQ ID NO: 35462
  hemagglutinin__InfluenzaA__ADG59670

SEQ ID NO: 35464 - RNA, 1701 nt, Artificial Sequence; identical to SEQ ID NO: 35462
  hemagglutinin__InfluenzaA__ADG59671

SEQ ID NO: 35465 - RNA, 1701 nt, Artificial Sequence; identical to SEQ ID NO: 35462
  hemagglutinin__InfluenzaA__ADG59672

SEQ ID NO: 35466 - RNA, 1701 nt, Artificial Sequence
  hemagglutinin__InfluenzaA__ADG59673
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuugggugaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuaguuguaccgagauaugcauucgcaauggaaagaaacgcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35467 - RNA, 1701 nt, Artificial Sequence
  hemagglutinin__InfluenzaA__ADG59674
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuuuuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauguacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcuccaaugggucucuacaguguagaauauguauuuaa

SEQ ID NO: 35468 - RNA, 1701 nt, Artificial Sequence
  hemagglutinin__InfluenzaA__ADG59675
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcuuagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaauggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguggauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguuaguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaagaaauagaugggguaaagcuggaaucaacgaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35469 - RNA, 1701 nt, Artificial Sequence
  hemagglutinin__InfluenzaA__ADG59676
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaaugcaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaaggauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35470 - RNA, 1701 nt, Artificial Sequence
  hemagglutinin__InfluenzaA__ADG59678
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggucuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35471 - RNA, 1701 nt, Artificial Sequence
  hemagglutinin__InfluenzaA__ADG59680
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35472 - RNA, 1701 nt, Artificial Sequence
  hemagglutinin__InfluenzaA__ADG59681
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuugugggaacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35473 - RNA, 1701 nt, Artificial Sequence
  hemagglutinin__InfluenzaA__ADG59683
augaaggcaauacuaguaguucugcuauauacauuugcaaucgcaaaugcagacacauuauguauagguuaucaugcgaacaauucaacagacacuguagacacaguacuaaaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugcugaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35474 - RNA, 1701 nt, Artificial Sequence
  hemagglutinin__InfluenzaA__ADG59684
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35475 - RNA, 1701 nt, Artificial Sequence
  hemagglutinin__InfluenzaA__ADG59685
augaaggcaauacuaguaguucugcuauauacauuugcaaccgcaaaugcagacacauuguguauagguuaucaugcgaacaauucaacagacacuauagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35476 - RNA, 1701 nt, Artificial Sequence
  hemagglutinin__InfluenzaA__ADG59686
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauaugugaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35477 - RNA, 1701 nt, Artificial Sequence
  hemagglutinin__InfluenzaA__ADG59687
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugaugagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35478 - RNA, 1701 nt, Artificial Sequence
  hemagglutinin__InfluenzaA__ADG59688
augaaggcaauacuaguaguucugcuauauacaauugcaaccgcaaaugcagacacauuguguauagguuaucaugcgaacaauucaacagacacuauagacacaguacuagaaaagaauguaacaguaacacacucuguuaaccuucuagaagacaagcauaacgggaaacuaugcaaacuaagagggguagcccccuugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35479 - RNA, 1701 nt, Artificial Sequence
  hemagglutinin__InfluenzaA__ADG59689
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugcgaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagggaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35480 - RNA, 1701 nt, Artificial Sequence
  hemagglutinin__InfluenzaA__ADG59691
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35481 - RNA, 1701 nt, Artificial Sequence
  hemagglutinin__InfluenzaA__ADG59693
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccacagcaagcucaugguccuacauuguggaaacaucuaguucagacaauggaacguguuacccaggagauuucaucgauuaugaggagcuaagagagcaauugaguucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaucaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35482 - RNA, 1701 nt, Artificial Sequence
  hemagglutinin__InfluenzaA__ADG59696
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35483 - RNA, 1701 nt, Artificial Sequence
  hemagglutinin__InfluenzaA__ADG59697
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaaacuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacaaaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35484 - RNA, 1701 nt, Artificial Sequence
  hemagglutinin__InfluenzaA__ADG59700
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacucaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35485 - RNA, 1701 nt, Artificial Sequence
  hemagglutinin__InfluenzaA__ADG59701
augaaggcaauacuaguaguucugcuauauacauuugcagccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgacaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35486 - RNA, 1701 nt, Artificial Sequence
  hemagglutinin__InfluenzaA__ADG59702
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggaguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagaaccgggggacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaaauuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaacgggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35487 - RNA, 1701 nt, Artificial Sequence
  hemagglutinin__InfluenzaA__ADG59703
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucaaaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauugucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcuccaaugggucucuacaguguagaauauguauuuaa

SEQ ID NO: 35488 - RNA, 1701 nt, Artificial Sequence; identical to SEQ ID NO: 33188
  hemagglutinin__InfluenzaA__ADG76646

SEQ ID NO: 35489 - RNA, 1701 nt, Artificial Sequence
  hemagglutinin__InfluenzaA__ADG76652
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucauucuccacaucaagcucaugguccuacauuguggaaacaccuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauacauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35490 - RNA, 1701 nt, Artificial Sequence
  hemagglutinin__InfluenzaA__ADH01808
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaagguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35491 - RNA, 1701 nt, Artificial Sequence
  hemagglutinin__InfluenzaA__ADH01818
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 35492 - RNA, 1701 nt, Artificial Sequence; identical to SEQ ID NO: 33457
  hemagglutinin__InfluenzaA__ADH01828

SEQ ID NO: 35493 - RNA, 1701 nt, Artificial Sequence
  hemagglutinin__InfluenzaA__ADH01838
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaguaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35494 - RNA, 1701 nt, Artificial Sequence; identical to SEQ ID NO: 33457
  hemagglutinin__InfluenzaA__ADH01848

SEQ ID NO: 35495 - RNA, 1701 nt, Artificial Sequence; identical to SEQ ID NO: 33457
  hemagglutinin__InfluenzaA__ADH01858

SEQ ID NO: 35496 - RNA, 1701 nt, Artificial Sequence
  hemagglutinin__InfluenzaA__ADH01868
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35497 - RNA, 1701 nt, Artificial Sequence; identical to SEQ ID NO: 33173
  hemagglutinin__InfluenzaA__ADH01878

SEQ ID NO: 35498 - RNA, 1701 nt, Artificial Sequence
  hemagglutinin__InfluenzaA__ADH01888
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauugcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35499 - RNA, 1701 nt, Artificial Sequence; identical to SEQ ID NO: 33173
  hemagglutinin__InfluenzaA__ADH01898

SEQ ID NO: 35500 - RNA, 1701 nt, Artificial Sequence; identical to SEQ ID NO: 33264
  hemagglutinin__InfluenzaA__ADH01908

SEQ ID NO: 35501 - RNA, 1701 nt, Artificial Sequence
  hemagglutinin__InfluenzaA__ADH01918
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagaaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35502 - RNA, 1701 nt, Artificial Sequence
  hemagglutinin__InfluenzaA__ADH01928
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagcgucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35503 - RNA, 1701 nt, Artificial Sequence
  hemagglutinin__InfluenzaA__ADH01938
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauauaaaaagguaagaagccaguuaaaaaacaaugccaaggaaauuggaaacggcugcuuugaauuuuaccacaagugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35504 - RNA, 1701 nt, Artificial Sequence
  hemagglutinin__InfluenzaA__ADH01948
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35505 - RNA, 1701 nt, Artificial Sequence
  hemagglutinin__InfluenzaA__ADH01958
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaauuguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccauaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 35506 - RNA, 1701 nt, Artificial Sequence
  hemagglutinin__InfluenzaA__ADH01968
augaaggcaauacuaguaguucugcuauauacauuugcaaccgcaaaugcagacacauuauguauagguuaucaugcgaacaauucaacagacacuguagacacagugcuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35507 - RNA, 1701 nt, Artificial Sequence
  hemagglutinin__InfluenzaA__ADH01978
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaggguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguggagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35508 - RNA, 1701 nt, Artificial Sequence
  hemagglutinin__InfluenzaA__ADH01988
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauccaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacgaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35509 - RNA, 1701 nt, Artificial Sequence
  hemagglutinin__InfluenzaA__ADH01998
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucgucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35510 - RNA, 1701 nt, Artificial Sequence
  hemagglutinin__InfluenzaA__ADH02008
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaaggcaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaauuaaaaaaggaaauucauacccaaagcucagcaaauccuacauuaaugauaaagagaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35511 - RNA, 1701 nt, Artificial Sequence; identical to SEQ ID NO: 34337
  hemagglutinin__InfluenzaA__ADI24508

SEQ ID NO: 35512 - RNA, 1701 nt, Artificial Sequence
  hemagglutinin__InfluenzaA__ADI24515
augaaggcaauacuaguaguucugcuauauacauuugcaaccgcaaaugcagacacauuauguguagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacuccccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagaguacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35513 - RNA, 1701 nt, Artificial Sequence; identical to SEQ ID NO: 34337
  hemagglutinin__InfluenzaA__ADI24517

SEQ ID NO: 35514 - RNA, 1701 nt, Artificial Sequence
  hemagglutinin__InfluenzaA__ADI24519
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35515 - RNA, 1701 nt, Artificial Sequence
  hemagglutinin__InfluenzaA__ADI24521
augaaggcaauacuaguaguucugcuauauacauuugcaaccgcaaaugcagacacauuauguauagguuaucaugcgaacaauucaacagacacuguagacacgguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggauggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35516 - RNA, 1701 nt, Artificial Sequence
  hemagglutinin__InfluenzaA__ADI24523
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35517 - RNA, 1701 nt, Artificial Sequence
  hemagglutinin__InfluenzaA__ADI24525
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcgaacuaagagggguagccccauugcauuuggguaaauguaacauugcuggcuggauccugggaaauccagagugugaaucacucuccacagcaagaucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaaaaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35518 - RNA, 1701 nt, Artificial Sequence
  hemagglutinin__InfluenzaA__ADI24527
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccauaaaugcgauaacacgugcauggaaagugucaaaaaugguacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35519 - RNA, 1701 nt, Artificial Sequence; identical to SEQ ID NO: 35516
  hemagglutinin__InfluenzaA__ADI24529

SEQ ID NO: 35520 - RNA, 1701 nt, Artificial Sequence
  hemagglutinin__InfluenzaA__ADI24531
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuacuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguaaaauauguauuuaa

SEQ ID NO: 35521 - RNA, 1701 nt, Artificial Sequence
  hemagglutinin__InfluenzaA__ADI24536
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35522 - RNA, 1701 nt, Artificial Sequence
  hemagglutinin__InfluenzaA__ADI24546
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35523 - RNA, 1701 nt, Artificial Sequence; identical to SEQ ID NO: 34337
  hemagglutinin__InfluenzaA__ADI24553

SEQ ID NO: 35524 - RNA, 1701 nt, Artificial Sequence; identical to SEQ ID NO: 34337
  hemagglutinin__InfluenzaA__ADI24555

SEQ ID NO: 35525 - RNA, 1701 nt, Artificial Sequence
  hemagglutinin__InfluenzaA__ADI24557
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35526 - RNA, 1701 nt, Artificial Sequence
  hemagglutinin__InfluenzaA__ADI24559
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuauugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35527 - RNA, 1701 nt, Artificial Sequence
  hemagglutinin__InfluenzaA__ADI24561
augaaggcaauacuaguaauucugcuauauacauuugcaacugcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35528 - RNA, 1701 nt, Artificial Sequence; identical to SEQ ID NO: 34337
  hemagglutinin__InfluenzaA__ADI24563

SEQ ID NO: 35529 - RNA, 1701 nt, Artificial Sequence
  hemagglutinin__InfluenzaA__ADI24565
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcaugacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugccggagcaaaaagcuucuacaaaaauuuaauauggcuaguuaaaaaaggaaauucauacccaaagcucagcaaauccuacauuaaugauaaggggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35530 - RNA, 1701 nt, Artificial Sequence
  hemagglutinin__InfluenzaA__ADI24567
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaauaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35531 - RNA, 1701 nt, Artificial Sequence
  hemagglutinin__InfluenzaA__ADI24569
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauagaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggagccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35532 - RNA, 1701 nt, Artificial Sequence
  hemagglutinin__InfluenzaA__ADI24571
augaaggcaauacuaguaguucugcuauauacauuugcaaccgcaaaugcagacacauuauguauagguuaucaugcgaacaauucaacagacacuguggacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35533 - RNA, 1701 nt, Artificial Sequence
  hemagglutinin__InfluenzaA__ADI24573
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagacacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35534 - RNA, 1701 nt, Artificial Sequence
  hemagglutinin__InfluenzaA__ADI24575
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaauguggagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35535 - RNA, 1701 nt, Artificial Sequence
  hemagglutinin__InfluenzaA__ADI24577
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacggaaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaaguacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35536 - RNA, 1701 nt, Artificial Sequence
  hemagglutinin__InfluenzaA__ADI24581
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggguccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauucccuaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauagaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaagaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35537 - RNA, 1701 nt, Artificial Sequence
  hemagglutinin__InfluenzaA__ADI24583
augaaggcaauacuaguaguucugcuauauacauuugcaaccgcaaacgcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaguccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccaaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35538 - RNA, 1701 nt, Artificial Sequence
  hemagglutinin__InfluenzaA__ADI24590
augaaggcaauacuaguaguucuguuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35539 - RNA, 1701 nt, Artificial Sequence
  hemagglutinin__InfluenzaA__ADI24597
augaaggcaauacuaguaguucugcuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaauuguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35540 - RNA, 1701 nt, Artificial Sequence
  hemagglutinin__InfluenzaA__ADI24612
augaaggcaauacuaguaguucugcuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaucaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35541 - RNA, 1701 nt, Artificial Sequence
  hemagglutinin__InfluenzaA__ADI24619
augaaggcaauacuaguaguucugcuauacacauuugcaaccgcaaaugcagacacauuauguauagguuaucaugcgaacaauucaacagacacuguagacacaguacuagaaaagaauguaacaguaacacacucugcuaaccuucuagaagacaagcauaacgggaaacuaugcaaacuaagaggaguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaaggaaaagaaguccucgugcuauggggcauucaccauccaucuacuaguguugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35542 - RNA, 1701 nt, Artificial Sequence
  hemagglutinin__InfluenzaA__ADI24621
augaaggcaauacuaguaguucugcuauauacauuugcaaccgcaaaugcagacacauuauguauagguuaucaugcgaacaacucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaggguacuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugauagucucccugggggcaaucaguuucuggaugugcucuaaugggucucuacaguguagaauauguauuuaa

SEQ ID NO: 35543 - RNA, 1701 nt, Artificial Sequence
  hemagglutinin__InfluenzaA__ADI48184
augaaggcaauacuaguaguucuguuauauacauuugcaaccgcaaaugcagacacauuaugcauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauuugcaaugggaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaagagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaggguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35544 - RNA, 1701 nt, Artificial Sequence
  hemagglutinin__InfluenzaA__ADI48186
augaaggcaauacuaguaguucuguuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35545 - RNA, 1701 nt, Artificial Sequence
  hemagglutinin__InfluenzaA__ADI48188
augaaggcaauacuaguaguucuguuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugauauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaagagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35546 - RNA, 1701 nt, Artificial Sequence
  hemagglutinin__InfluenzaA__ADI48190
augaaggcaauacuaguaguucuguuauauacauuugcaaccgcaaaugcagacacauuauguauagguuaucaugcgaacaauucaacagauacuguagacacaguacuagaaaagaauguaacaguaacacacucuguuaaccuucuagaagacaagcauaacgggaaacugugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaagagaauagagaauuuaaauaaaaaaguugaugaugguuuccuggacauuuggacuuacaaugccgaauuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggauguguucuaaugggucucuacaguguagaauauguauuuaa

SEQ ID NO: 35547 - RNA, 1701 nt, Artificial Sequence
  hemagglutinin__InfluenzaA__ADI48192
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuugacgaucuauucaacugucgccaguucauugguacugguagucucccugggggcaaucaguuucuggauguguucuaaugggucucuacaguguagaauauguauuuaa

SEQ ID NO: 35548 - RNA, 1701 nt, Artificial Sequence
  hemagglutinin__InfluenzaA__ADI48194
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcuuagugucaucauuugaaagguuugagauauuccccaagacaaauucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggagagugucaaaaaugggacuuaugacuacccaaaauacucagaggaagcaaaauuaaacagagaagaaauagaugggguaaagcuggaaucaacaaggauuuaccagauuuuggcgauuuauucaacugucgccaguucauugguacugguagucucccugggggcaaucaguuucuggauguguucuaaugggucucuacaguguagaauauguauuuaa

SEQ ID NO: 35549 - RNA, 1701 nt, Artificial Sequence
  hemagglutinin__InfluenzaA__ADI48196
augaaggcaauacuaguaguucugcuauacacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaaguuggacucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35550 - RNA, 1701 nt, Artificial Sequence
  hemagglutinin__InfluenzaA__ADI48198
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuuuuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35551 - RNA, 1701 nt, Artificial Sequence; identical to SEQ ID NO: 35550
  hemagglutinin__InfluenzaA__ADI48200

SEQ ID NO: 35552 - RNA, 1701 nt, Artificial Sequence
  hemagglutinin__InfluenzaA__ADI48202
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagauaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuuuuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35553 - RNA, 1701 nt, Artificial Sequence
  hemagglutinin__InfluenzaA__ADI48204
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaauguagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaaaaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuuuuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35554 - RNA, 1701 nt, Artificial Sequence
  hemagglutinin__InfluenzaA__ADI48208
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagauggggugaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35555 - RNA, 1701 nt, Artificial Sequence
  hemagglutinin__InfluenzaA__ADI48210
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35556 - RNA, 1701 nt, Artificial Sequence
  hemagglutinin__InfluenzaA__ADI48212
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacguuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35557 - RNA, 1701 nt, Artificial Sequence
  hemagglutinin__InfluenzaA__ADI48214
augaaggcaauacuaguaguucugcuauauacauuugcaaucgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuggcagucucccugggggcaaucaguuucuggaugugcucuaaugggucucuacaguguagaauauguauuuaa

SEQ ID NO: 35558 - RNA, 1701 nt, Artificial Sequence; identical to SEQ ID NO: 35556
  hemagglutinin__InfluenzaA__ADI48216

SEQ ID NO: 35559 - RNA, 1701 nt, Artificial Sequence
  hemagglutinin__InfluenzaA__ADI48218
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccaagauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35560 - RNA, 1701 nt, Artificial Sequence
  hemagglutinin__InfluenzaA__ADI48220
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaguguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaaacaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuugggcuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35561 - RNA, 1701 nt, Artificial Sequence
  hemagglutinin__InfluenzaA__ADI48622
augaaggcaauacuaguauuucugcuauauacauuugcaaccgcaaaugcagacacauuauguauagguuaucaugcgaacaauucaacggacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35562 - RNA, 1701 nt, Artificial Sequence
  hemagglutinin__InfluenzaA__ADI48632
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcguucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35563 - RNA, 1701 nt, Artificial Sequence; identical to SEQ ID NO: 33457
  hemagglutinin__InfluenzaA__ADI48642

SEQ ID NO: 35564 - RNA, 1701 nt, Artificial Sequence; identical to SEQ ID NO: 33457
  hemagglutinin__InfluenzaA__ADI48652

SEQ ID NO: 35565 - RNA, 1701 nt, Artificial Sequence
  hemagglutinin__InfluenzaA__ADI48672
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaacaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35566 - RNA, 1701 nt, Artificial Sequence; identical to SEQ ID NO: 33173
  hemagglutinin__InfluenzaA__ADI48682

SEQ ID NO: 35567 - RNA, 1701 nt, Artificial Sequence; identical to SEQ ID NO: 33457
  hemagglutinin__InfluenzaA__ADI48692

SEQ ID NO: 35568 - RNA, 1701 nt, Artificial Sequence; identical to SEQ ID NO: 33390
  hemagglutinin__InfluenzaA__ADI48702

SEQ ID NO: 35569 - RNA, 1701 nt, Artificial Sequence
  hemagglutinin__InfluenzaA__ADI48712
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35570 - RNA, 1701 nt, Artificial Sequence; identical to SEQ ID NO: 35569
  hemagglutinin__InfluenzaA__ADI48722

SEQ ID NO: 35571 - RNA, 1701 nt, Artificial Sequence; identical to SEQ ID NO: 33173
  hemagglutinin__InfluenzaA__ADI48732

SEQ ID NO: 35572 - RNA, 1701 nt, Artificial Sequence
  hemagglutinin__InfluenzaA__ADI48742
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugauucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35573 - RNA, 1701 nt, Artificial Sequence
  hemagglutinin__InfluenzaA__ADI48752
auggaggcaauacuaguauuucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguauaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35574 - RNA, 1701 nt, Artificial Sequence; identical to SEQ ID NO: 33457
  hemagglutinin__InfluenzaA__ADI48762

SEQ ID NO: 35575 - RNA, 1701 nt, Artificial Sequence
  hemagglutinin__InfluenzaA__ADI48772
auggaggcaauacuaguaguucugcuauauacauuugcaaccgcaaaugcagacacauuauguauagguuaucaagcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggucuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35576 - RNA, 1701 nt, Artificial Sequence
  hemagglutinin__InfluenzaA__ADI48782
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaaucaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35577 - RNA, 1701 nt, Artificial Sequence
  hemagglutinin__InfluenzaA__ADI48792
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauauuuuuguggggucaucaagauacagcaagaaguucaagccggaaauagcaauaagacccaaagugagggaucaggaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35578 - RNA, 1701 nt, Artificial Sequence
  hemagglutinin__InfluenzaA__ADI49029
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuauuucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaagaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35579 - RNA, 1701 nt, Artificial Sequence; identical to SEQ ID NO: 33457
  hemagglutinin__InfluenzaA__ADI49240

SEQ ID NO: 35580 - RNA, 1701 nt, Artificial Sequence; identical to SEQ ID NO: 33457
  hemagglutinin__InfluenzaA__ADI49260

SEQ ID NO: 35581 - RNA, 1701 nt, Artificial Sequence
  hemagglutinin__InfluenzaA__ADI49270
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuauguaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccagggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35582 - RNA, 1701 nt, Artificial Sequence; identical to SEQ ID NO: 33457
  hemagglutinin__InfluenzaA__ADI49280

SEQ ID NO: 35583 - RNA, 1701 nt, Artificial Sequence; identical to SEQ ID NO: 33457
  hemagglutinin__InfluenzaA__ADI49312

SEQ ID NO: 35584 - RNA, 1701 nt, Artificial Sequence
  hemagglutinin__InfluenzaA__ADI49322
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaaugggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaggaagggagaaugaacuauuacuggacacuaguagagccgggagacaaaauaacauucgaagcaacuggaaauuuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaagguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35585 - RNA, 1701 nt, Artificial Sequence; identical to SEQ ID NO: 33457
  hemagglutinin__InfluenzaA__ADI49332

SEQ ID NO: 35586 - RNA, 1701 nt, Artificial Sequence; identical to SEQ ID NO: 33742
  hemagglutinin__InfluenzaA__ADI49342

SEQ ID NO: 35587 - RNA, 1701 nt, Artificial Sequence
  hemagglutinin__InfluenzaA__ADI49352
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaagugaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35588 - RNA, 1701 nt, Artificial Sequence
  hemagglutinin__InfluenzaA__ADI49362
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccagaaauagcaauaagacccaaagugagggaucaagaagggagaaugaacuauuacuggacacuaguagagccgggagacaaaauaacauucgaagcaacuggaaauuuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35589 - RNA, 1701 nt, Artificial Sequence
  hemagglutinin__InfluenzaA__ADI49382
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauaggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauugaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35590 - RNA, 1701 nt, Artificial Sequence
  hemagglutinin__InfluenzaA__ADI49392
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagggagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35591 - RNA, 1701 nt, Artificial Sequence; identical to SEQ ID NO: 33197
  hemagglutinin__InfluenzaA__ADI49717

SEQ ID NO: 35592 - RNA, 1701 nt, Artificial Sequence
  hemagglutinin__InfluenzaA__ADI49727
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuauuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35593 - RNA, 1701 nt, Artificial Sequence; identical to SEQ ID NO: 33197
  hemagglutinin__InfluenzaA__ADI49737

SEQ ID NO: 35594 - RNA, 1701 nt, Artificial Sequence; identical to SEQ ID NO: 33197
  hemagglutinin__InfluenzaA__ADI49747

SEQ ID NO: 35595 - RNA, 1701 nt, Artificial Sequence
  hemagglutinin__InfluenzaA__ADI49757
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaguaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35596 - RNA, 1701 nt, Artificial Sequence
  hemagglutinin__InfluenzaA__ADI49767
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagauaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauguuccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35597 - RNA, 1701 nt, Artificial Sequence
  hemagglutinin__InfluenzaA__ADI49777
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacgauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35598 - RNA, 1701 nt, Artificial Sequence
  hemagglutinin__InfluenzaA__ADI49787
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucaaucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucgagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35599 - RNA, 1701 nt, Artificial Sequence
  hemagglutinin__InfluenzaA__ADI49822
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagagaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35600 - RNA, 1701 nt, Artificial Sequence
  hemagglutinin__InfluenzaA__ADI50027
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauaagacccaaagugagggaucaagaagggagaaugaaauauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacggucaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35601 - RNA, 1701 nt, Artificial Sequence
  hemagglutinin__InfluenzaA__ADI52834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcaucuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuugugggaucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggaccuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35602 - RNA, 1701 nt, Artificial Sequence
  hemagglutinin__InfluenzaA__ADI52835
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaccuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35603 - RNA, 1701 nt, Artificial Sequence
  hemagglutinin__InfluenzaA__ADI52836
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaagaaaauucauacccaaagcucagcaaauccuacauuaaugauaaagggaaagaaguccucgugcuauggggcauucaccauccaucuacuagugcugaccaacaacgucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35604 - RNA, 1701 nt, Artificial Sequence
  hemagglutinin__InfluenzaA__ADI52837
auggaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagucaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaaaauacagcaagaaguucaagccggaaauagcaauaagacccaaagugagggaucaagaagggagaaugaacuauuacuggacacuaguagagccgggagacaaaauaacauucgaagcaaauggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35605 - RNA, 1701 nt, Artificial Sequence; identical to SEQ ID NO: 33971
  hemagglutinin__InfluenzaA__ADI72915

SEQ ID NO: 35606 - RNA, 1701 nt, Artificial Sequence; identical to SEQ ID NO: 33971
  hemagglutinin__InfluenzaA__ADI72916

SEQ ID NO: 35607 - RNA, 1701 nt, Artificial Sequence; identical to SEQ ID NO: 33971
  hemagglutinin__InfluenzaA__ADI72917

SEQ ID NO: 35608 - RNA, 1701 nt, Artificial Sequence
  hemagglutinin__InfluenzaA__ADI72918
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauagagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35609 - RNA, 1701 nt, Artificial Sequence; identical to SEQ ID NO: 33971
  hemagglutinin__InfluenzaA__ADI72919

SEQ ID NO: 35610 - RNA, 1701 nt, Artificial Sequence; identical to SEQ ID NO: 33971
  hemagglutinin__InfluenzaA__ADI72920

SEQ ID NO: 35611 - RNA, 1701 nt, Artificial Sequence
  hemagglutinin__InfluenzaA__ADI72921
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugcccuugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35612 - RNA, 1701 nt, Artificial Sequence
  hemagglutinin__InfluenzaA__ADI72922
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggauggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35613 - RNA, 1701 nt, Artificial Sequence
  hemagglutinin__InfluenzaA__ADI72923
augaaggcaauacuaguaguucugcuauauacauuugcaaccucaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaccugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagggaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35614 - RNA, 1701 nt, Artificial Sequence
  hemagglutinin__InfluenzaA__ADI72924
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35615 - RNA, 1701 nt, Artificial Sequence; identical to SEQ ID NO: 34870
  hemagglutinin__InfluenzaA__ADI72925

SEQ ID NO: 35616 - RNA, 1701 nt, Artificial Sequence
  hemagglutinin__InfluenzaA__ADI72926
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaggauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35617 - RNA, 1701 nt, Artificial Sequence
  hemagglutinin__InfluenzaA__ADI72927
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucacuucagauacgccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35618 - RNA, 1701 nt, Artificial Sequence
  hemagglutinin__InfluenzaA__ADI72928
augaaggcaauacuaguaguucugcuauauacauuugcaaccgcaaaugcagacacauuauguauagguuaucaugcgaacaauucaacagacacuguagacacaauacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagaaaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35619 - RNA, 1701 nt, Artificial Sequence
  hemagglutinin__InfluenzaA__ADI72929
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucacgcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaauucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35620 - RNA, 1701 nt, Artificial Sequence
  hemagglutinin__InfluenzaA__ADI72930
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaguugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 35621 - RNA, 1701 nt, Artificial Sequence
  hemagglutinin__InfluenzaA__ADI72931
augaaggcaauacuaguaguucugcuauauacauuugcaaccgcaaaugcagacacauuauguauagguuaucaugcgaacaauucaacagacacuguagacacaguacuagaaaagaauguaacgguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35622 - RNA, 1701 nt, Artificial Sequence; identical to SEQ ID NO: 34829
  hemagglutinin__InfluenzaA__ADI72932

SEQ ID NO: 35623 - RNA, 1698 nt, Artificial Sequence
  hemagglutinin__InfluenzaA__ADI75818
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuauugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacaagaauuuguuauggcugacggagaagaaugguuuguacccgaaccugagcaaguccuaugcaaacaacaaagaaaaagaaguccuuguacuaugggguguucaucacccgccaagcauaagugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaacaaaaaaguugaugauggcuuuauagacauuuggacauauaaugcagaacuguugguucuacuggaaaaugaaaggacuuuggauuuccaugacuccaaugugaagaaucuguaugagaaaguaaaaaaccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 35624 - RNA, 1698 nt, Artificial Sequence
  hemagglutinin__InfluenzaA__ADI75851
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacugcaauuggguaacugcagcguugccggguggaucuuaggaaacccagaaugcggauuacugauuuccaaagagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaguugaccaaaaaacccucuaccguacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaaugggacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 35625 - RNA, 1701 nt, Artificial Sequence
  hemagglutinin__InfluenzaA__ADI75884
augaagacuaucauugcuuugagcuacauucuaugucugguuuucgcucaaaaacuuccuggaaaugacaacagcacggcaacgcugugccuugggcaccaugcaguaccaaacggaacgauagugaaaacaauuacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35626 - RNA, 1701 nt, Artificial Sequence
  hemagglutinin__InfluenzaA__ADI75917
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacaguaucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauccaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagggaugaagcauugaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35627 - RNA, 1698 nt, Artificial Sequence
  hemagglutinin__InfluenzaA__ADI77349
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccaggacauuucgcugacuaugaggaacugagggagcaauugaguucaguaucuucauuugagagguucgaaauauuccccaaagaaagcucauggcccaaccacaccguaaccggagugucagcaucaugcucccauaauggggaaaacaguuuuuacagaaauuugcuauggcugacggggaagaaugguuuguacccaaaccugagcaaguccuaugcaaacaacaaagaaaaagaaguccuuauacuaugggguguucaucacccgccaaacauggcugaccaaaagacccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugauacgaagugccaaacaccucaaggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 35628 - RNA, 1701 nt, Artificial Sequence; identical to SEQ ID NO: 33173
  hemagglutinin__InfluenzaA__ADI77360

SEQ ID NO: 35629 - RNA, 1701 nt, Artificial Sequence
  hemagglutinin__InfluenzaA__ADI99498
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuauauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggucaagaagggagaaugaacuauuacuggacacuaguaaagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35630 - RNA, 1701 nt, Artificial Sequence
  hemagglutinin__InfluenzaA__ADI99560
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaauggcugcuuugaauuuuaccacaaaugcaauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35631 - RNA, 1701 nt, Artificial Sequence; identical to SEQ ID NO: 35630
  hemagglutinin__InfluenzaA__ADI99570

SEQ ID NO: 35632 - RNA, 1701 nt, Artificial Sequence; identical to SEQ ID NO: 35630
  hemagglutinin__InfluenzaA__ADI99580

SEQ ID NO: 35633 - RNA, 1701 nt, Artificial Sequence
  hemagglutinin__InfluenzaA__ADI99590
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuagaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35634 - RNA, 1701 nt, Artificial Sequence
  hemagglutinin__InfluenzaA__ADI99610
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggaguuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaauccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35635 - RNA, 1701 nt, Artificial Sequence
  hemagglutinin__InfluenzaA__ADI99620
augaaggcgauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucacagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35636 - RNA, 1701 nt, Artificial Sequence
  hemagglutinin__InfluenzaA__ADI99630
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagaauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggaaauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccaugauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35637 - RNA, 1701 nt, Artificial Sequence
  hemagglutinin__InfluenzaA__ADI99640
augaaggcaauacuaguaguucugcuauauacauuugcaaccgcaaaugcagacacauuauguauagguuaucaugcgaacaauucaacagacacuguagacacaguacuagaaaagaauguaacaguaacacauucuguuaaccuucuagaagacaagcauaacgggaaacuaugcaaacuaagagggguagccccauugcauuuggguaaauguaacauugcuggcuggauucugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagauuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuaguacugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaauccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35638 - RNA, 1701 nt, Artificial Sequence; identical to SEQ ID NO: 34731
  hemagglutinin__InfluenzaA__ADI99660

SEQ ID NO: 35639 - RNA, 1701 nt, Artificial Sequence
  hemagglutinin__InfluenzaA__ADI99670
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuauggcuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35640 - RNA, 1701 nt, Artificial Sequence
  hemagglutinin__InfluenzaA__ADI99680
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucguuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccacccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacaauaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35641 - RNA, 1701 nt, Artificial Sequence
  hemagglutinin__InfluenzaA__ADI99690
augaaggcaauacuagcaguucugcuauauacauuugcaaucgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagaaugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauaugguuaguuaaaaaaggaaacucauacccaaagcucagcaaauccuacauuaaugauaaagggaaaaaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccaugauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 35642 - RNA, 1701 nt, Artificial Sequence
  hemagglutinin__InfluenzaA__ADI99700
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguauccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcguucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacauuaguagagccgggagacaaaauaacauucgaagcaacuggaaaucuaguggcaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaacacacaguucacagcaguagguaaagaguucaaccaccuggagaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35643 - RNA, 1701 nt, Artificial Sequence
  hemagglutinin__InfluenzaA__ADI99710
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuauuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35644 - RNA, 1701 nt, Artificial Sequence
  hemagglutinin__InfluenzaA__ADI99720
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggaucuugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccgaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggggacaagaagggagaaugaacuauuacuggacacuaguagagccgggagacaaaauaacauucgaagcaacuggaaaucuagugguaucgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35645 - RNA, 1701 nt, Artificial Sequence
  hemagglutinin__InfluenzaA__ADI99730
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagcagaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35646 - RNA, 1701 nt, Artificial Sequence; identical to SEQ ID NO: 33173
  hemagglutinin__InfluenzaA__ADJ00497

SEQ ID NO: 35647 - RNA, 1701 nt, Artificial Sequence; identical to SEQ ID NO: 33173
  hemagglutinin__InfluenzaA__ADJ00498

SEQ ID NO: 35648 - RNA, 1701 nt, Artificial Sequence
  hemagglutinin__InfluenzaA__ADJ00501
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35649 - RNA, 1701 nt, Artificial Sequence
  hemagglutinin__InfluenzaA__ADJ18163
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacaccuaagggugcuauaaacaccagccucccauuucagaauauacauccgaucacaauuggaaaauguccaaaauauguaaaaagcacaaaauugagacuggccacaggauugaggaaugucccgucuauucaaucuagaggacuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35650 - RNA, 1701 nt, Artificial Sequence
  hemagglutinin__InfluenzaA__ADJ18165
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccaagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35651 - RNA, 1701 nt, Artificial Sequence
  hemagglutinin__InfluenzaA__ADJ18167
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuagguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuuaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaagaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35652 - RNA, 1701 nt, Artificial Sequence
  hemagglutinin__InfluenzaA__ADJ18169
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucgagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35653 - RNA, 1701 nt, Artificial Sequence
  hemagglutinin__InfluenzaA__ADJ18171
augaaggcaauacuaguaguucugcuauauacauuugcaaccgcaaaugcagacacauuauguauagguuaucaugcgaacaauucaacagacacuguagacaccguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucauggcccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuaccaaaauuuaauauggcuaguuaaaaaaggaaauucauacccaaagcucagcaaauccuacauucaugauaaagggaaagaaguccucgugcuauggggcauucaccauccaucuacuagugcugaccaacaaagucucuaucagaaugcagaugcauauguuuuuguggggacaucaagauacaguaagaaguucaaaccggaaauagcaauaagacccaaagugagggaucgacaagggagaaugaacuauuacuggacacuaguagagcugggagacaaaauaacauucgaagcaacuggaaaucuagugguaccaagauaugcauucgcaauggaaagaaaugcuggaucugguauuaucauuucagauacaccaguccacaauugcaauacaacuugucagacaaccacgggugcuauaaauaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcagggaucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35654 - RNA, 1701 nt, Artificial Sequence
  hemagglutinin__InfluenzaA__ADJ18173
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggacuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35655 - RNA, 1701 nt, Artificial Sequence
  hemagglutinin__InfluenzaA__ADJ18175
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucuuuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggacuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35656 - RNA, 1701 nt, Artificial Sequence
  hemagglutinin__InfluenzaA__ADJ18177
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuaccagugcugaccaacaaagucuuuaucagaaugcagaugcauauguuuuuguggggacaucaagauacagcaagaaguucaagccggaaauagcaauaagacccaaagugaggggucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuguucaaucuagaggccuauuuggggccauugccgguuucauugaagggggguggacagggaugguagauggaugguacgguuaucaccaucaaaaugagcaggggucaggauaugcagccgaucugaagagcacacagaaugcaauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35657 - RNA, 1701 nt, Artificial Sequence
  hemagglutinin__InfluenzaA__ADJ40444
augaaggcaauacuaguaguucugcuauauacauuugcaaccgcaaaugcagacacauuauguauagguuaucaugcgaacaauucaacagacacuguagacacaguacuaaaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugacaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35658 - RNA, 1701 nt, Artificial Sequence
  hemagglutinin__InfluenzaA__ADJ40454
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaaugcaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuauuggacacuaguagaaccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguagagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35659 - RNA, 1701 nt, Artificial Sequence
  hemagglutinin__InfluenzaA__ADJ40464
augaaggcaauacuaguaguucugcuauauacauuugcaaccgcaaauacagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugauucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35660 - RNA, 1701 nt, Artificial Sequence
  hemagglutinin__InfluenzaA__ADJ40474
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuugauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagacaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35661 - RNA, 1701 nt, Artificial Sequence
  hemagglutinin__InfluenzaA__ADJ40494
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaacuuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35662 - RNA, 1701 nt, Artificial Sequence
  hemagglutinin__InfluenzaA__ADJ40514
augaaggcaguacuaguaguucugcuauauacauuugcaaccacaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35663 - RNA, 1701 nt, Artificial Sequence; identical to SEQ ID NO: 33206
  hemagglutinin__InfluenzaA__ADJ40524

SEQ ID NO: 35664 - RNA, 1701 nt, Artificial Sequence
  hemagglutinin__InfluenzaA__ADJ40534
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugagucacucuccaccgcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35665 - RNA, 1701 nt, Artificial Sequence
  hemagglutinin__InfluenzaA__ADJ40554
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35666 - RNA, 1701 nt, Artificial Sequence
  hemagglutinin__InfluenzaA__ADJ40564
augaaggcaauacuaguaguucugcuguauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccuaccauuucagaauauacauccgaucacaauuggaaaauguccaaaauauguaaaaagcacaaaauugagacuggccacaggauugaggaaugucccuucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagaucuuggcgaucuauucaacugucgccaguucauugguacugguagucucccugggggcaaucaguuucuggaugugcucuaaugggucucuacaguguagaauauguauuuaa

SEQ ID NO: 35667 - RNA, 1701 nt, Artificial Sequence
  hemagglutinin__InfluenzaA__ADJ40574
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuugugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35668 - RNA, 1701 nt, Artificial Sequence
  hemagglutinin__InfluenzaA__ADJ40584
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguacuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35669 - RNA, 1701 nt, Artificial Sequence; identical to SEQ ID NO: 33206
  hemagglutinin__InfluenzaA__ADJ40594

SEQ ID NO: 35670 - RNA, 1701 nt, Artificial Sequence
  hemagglutinin__InfluenzaA__ADJ40604
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35671 - RNA, 1701 nt, Artificial Sequence; identical to SEQ ID NO: 35670
  hemagglutinin__InfluenzaA__ADJ40614

SEQ ID NO: 35672 - RNA, 1701 nt, Artificial Sequence; identical to SEQ ID NO: 34493
  hemagglutinin__InfluenzaA__ADJ40634

SEQ ID NO: 35673 - RNA, 1701 nt, Artificial Sequence
  hemagglutinin__InfluenzaA__ADJ40644
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaauuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuuuuggaugugcucuaaugggucucuacaguguagaauauguauuuaa

SEQ ID NO: 35674 - RNA, 1701 nt, Artificial Sequence; identical to SEQ ID NO: 33955
  hemagglutinin__InfluenzaA__ADJ40654

SEQ ID NO: 35675 - RNA, 1701 nt, Artificial Sequence; identical to SEQ ID NO: 33206
  hemagglutinin__InfluenzaA__ADJ40664

SEQ ID NO: 35676 - RNA, 1701 nt, Artificial Sequence; identical to SEQ ID NO: 33206
  hemagglutinin__InfluenzaA__ADJ40674

SEQ ID NO: 35677 - RNA, 1701 nt, Artificial Sequence
  hemagglutinin__InfluenzaA__ADJ41816
augaagacuaucauugcuuugagcuacauguucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguaggauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccagauuaugccucccuuaggucacuaguugccucaucaggcacccuggaguuuaucaaugaaggcuucaauuggacuggagucacucagagugggggaagcuguacuugcaaaaggggaucuaaugacaguuucuucaguagacugaacugguuguacgaaucagaaagcaaauauccagugcugaacgugacuaugccaaacaauggcaaauuugacaaauuguacauuugggggauucaccacccgagcacggacaaagaacaaaccaaccuauauauucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaguagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 35678 - RNA, 1701 nt, Artificial Sequence; identical to SEQ ID NO: 34259
  hemagglutinin__InfluenzaA__ADJ56640

SEQ ID NO: 35679 - RNA, 1701 nt, Artificial Sequence
  hemagglutinin__InfluenzaA__ADJ56650
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacccgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggauggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauauggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35680 - RNA, 1701 nt, Artificial Sequence; identical to SEQ ID NO: 33264
  hemagglutinin__InfluenzaA__ADJ67983

SEQ ID NO: 35681 - RNA, 1701 nt, Artificial Sequence
  hemagglutinin__InfluenzaA__ADJ67984
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaaaacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaauugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35682 - RNA, 1701 nt, Artificial Sequence; identical to SEQ ID NO: 33264
  hemagglutinin__InfluenzaA__ADJ67985

SEQ ID NO: 35683 - RNA, 1701 nt, Artificial Sequence
  hemagglutinin__InfluenzaA__ADJ80241
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugaggaaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35684 - RNA, 1701 nt, Artificial Sequence
  hemagglutinin__InfluenzaA__ADJ80242
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaacuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35685 - RNA, 1701 nt, Artificial Sequence
  hemagglutinin__InfluenzaA__ADJ80243
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuguggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauuaaggaaugucccgucuauucaaucuagaggccuauuuggggccauugccgguuucauugaagggggguggacagggaugguagauggaugguacgguuaucaccaucaaaaugagcaggggucaggauaugcagccgaccugaaaagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35686 - RNA, 1701 nt, Artificial Sequence; identical to SEQ ID NO: 33173
  hemagglutinin__InfluenzaA__ADJ80634

SEQ ID NO: 35687 - RNA, 1701 nt, Artificial Sequence
  hemagglutinin__InfluenzaA__ADJ80644
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugacucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35688 - RNA, 1701 nt, Artificial Sequence
  hemagglutinin__InfluenzaA__ADJ80654
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugacucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugauuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35689 - RNA, 1701 nt, Artificial Sequence
  hemagglutinin__InfluenzaA__ADJ80674
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaaacucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35690 - RNA, 1701 nt, Artificial Sequence
  hemagglutinin__InfluenzaA__ADJ80684
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggaacuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35691 - RNA, 1701 nt, Artificial Sequence
  hemagglutinin__InfluenzaA__ADJ80694
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaaucauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35692 - RNA, 1701 nt, Artificial Sequence; identical to SEQ ID NO: 34337
  hemagglutinin__InfluenzaA__ADJ80704

SEQ ID NO: 35693 - RNA, 1701 nt, Artificial Sequence
  hemagglutinin__InfluenzaA__ADJ80714
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagaggggcagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggaugcuuugaauuuuaccacaaaugcgauaacacgugcauggaaagugucaaaaaugggacuuaugacuacccaaaauacucagaggaagcaaaauuaaacagagaagaaauagaugggguaaagcuagaaucaacaaggauuuaccagauuuuggcgaucuauucaacugucgccaguuccuugguacugguagucucccugggggcaaucaguuucuggaugugcucuaaugggucucuacaguguagaauauguauuuaa

SEQ ID NO: 35694 - RNA, 1701 nt, Artificial Sequence
  hemagglutinin__InfluenzaA__ADJ80724
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauaugugaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35695 - RNA, 1701 nt, Artificial Sequence
  hemagglutinin__InfluenzaA__ADJ80734
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaauuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggccgcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaauucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35696 - RNA, 1701 nt, Artificial Sequence
  hemagglutinin__InfluenzaA__ADJ80744
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucgaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35697 - RNA, 1701 nt, Artificial Sequence
  hemagglutinin__InfluenzaA__ADJ80754
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuaaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35698 - RNA, 1701 nt, Artificial Sequence
  hemagglutinin__InfluenzaA__ADJ80774
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaaacucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35699 - RNA, 1701 nt, Artificial Sequence
  hemagglutinin__InfluenzaA__ADJ80784
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucauaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35700 - RNA, 1701 nt, Artificial Sequence; identical to SEQ ID NO: 34337
  hemagglutinin__InfluenzaA__ADJ80794

SEQ ID NO: 35701 - RNA, 1701 nt, Artificial Sequence; identical to SEQ ID NO: 35688
  hemagglutinin__InfluenzaA__ADJ80804

SEQ ID NO: 35702 - RNA, 1701 nt, Artificial Sequence
  hemagglutinin__InfluenzaA__ADJ80814
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaggguguaacggcagcauguccucgugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaaaccggaaauagcaauaagacccaaagugagggaucaagaagggagaaugaacuauuacuggacacuaguagagccgggagacaaaauaacauucgaagcaacuggaaaucuagugguaccgagauaugcauucgcaauagaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35703 - RNA, 1701 nt, Artificial Sequence
  hemagglutinin__InfluenzaA__ADJ80834
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaauucuggaucugguauuaucauuucagacacaccaguccacuauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuugacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35704 - RNA, 1701 nt, Artificial Sequence
  hemagglutinin__InfluenzaA__ADJ80848
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucgagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35705 - RNA, 1701 nt, Artificial Sequence
  hemagglutinin__InfluenzaA__ADJ80858
augaagacaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucaaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35706 - RNA, 1701 nt, Artificial Sequence
  hemagglutinin__InfluenzaA__ADJ80868
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuaaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggaggcaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35707 - RNA, 1701 nt, Artificial Sequence
  hemagglutinin__InfluenzaA__ADJ80883
augaaggcaauacuaguaguucugcuauauacauuugcaaccgcaaaugcagacacauuauguauagguuaucaugcgaacaauucaacagacaccguagacacagugcuagaaaagaauguaacaguaacacacucuguuaaccuucuagaagauaaacauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagguaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacaggaaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35708 - RNA, 1701 nt, Artificial Sequence; identical to SEQ ID NO: 35689
  hemagglutinin__InfluenzaA__ADJ80893

SEQ ID NO: 35709 - RNA, 1701 nt, Artificial Sequence; identical to SEQ ID NO: 34337
  hemagglutinin__InfluenzaA__ADJ80910

SEQ ID NO: 35710 - RNA, 1701 nt, Artificial Sequence
  hemagglutinin__InfluenzaA__ADJ80927
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaggcaacuggaaaucuagugguaccgagauaugcauucgcaauggaaagaaaugcuggaucugguauuaucauuucagauacaccaguucacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggucuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35711 - RNA, 1701 nt, Artificial Sequence
  hemagglutinin__InfluenzaA__ADJ80937
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacaauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagagcuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35712 - RNA, 1701 nt, Artificial Sequence
  hemagglutinin__InfluenzaA__ADJ80947
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccuugugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35713 - RNA, 1701 nt, Artificial Sequence
  hemagglutinin__InfluenzaA__ADJ80967
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcugagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35714 - RNA, 1701 nt, Artificial Sequence
  hemagglutinin__InfluenzaA__ADJ80977
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucauugauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35715 - RNA, 1701 nt, Artificial Sequence
  hemagglutinin__InfluenzaA__ADJ80993
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuaaugcuggagcaaaaagcuucuacaaaaauuuaauauggcuaguuaaaaaaggaaauucauacccaaagcucagcaaaucuuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35716 - RNA, 1701 nt, Artificial Sequence
  hemagglutinin__InfluenzaA__ADJ81003
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauucccaaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35717 - RNA, 1701 nt, Artificial Sequence; identical to SEQ ID NO: 35375
  hemagglutinin__InfluenzaA__ADJ81013

SEQ ID NO: 35718 - RNA, 1701 nt, Artificial Sequence
  hemagglutinin__InfluenzaA__ADJ81023
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaacccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauguuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucaacaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguaaaaagcacaaaauugagacuggccacaggguugaggaaugucccgucuauucaaucuagaggccuauuuggagccauugccgguuucauugaagggggguggacagggaugguagauggaugguacgguuaccaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35719 - RNA, 1701 nt, Artificial Sequence
  hemagglutinin__InfluenzaA__ADJ81033
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaaguguaaaaaaugggacuuaugacuacccaaaauacucagaggaagcaaaauuaaacagagaagaaauagauggaguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35720 - RNA, 1701 nt, Artificial Sequence
  hemagglutinin__InfluenzaA__ADJ81043
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggaguaacggcagcauguccucaugcuggagcaaaaagcuucuacaaaaaucuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35721 - RNA, 1701 nt, Artificial Sequence
  hemagglutinin__InfluenzaA__ADJ81053
augaaggcaauacuaguaguucugcuauauacauuuacaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaauuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaagggaaauucauacccaaagcucagcaaauccuacaucaaugauaaagggaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauugggaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaacacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35722 - RNA, 1701 nt, Artificial Sequence
  hemagglutinin__InfluenzaA__ADJ81063
augaaggcaauacuaguaguucugcuauauacauuugcaaccgcaaaugcagacacauuauguauagguuaucaugcgaacaauucaacagacacuguagacacaguacuagaaaagaauguaacaguaacacacucgguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcguguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagccucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauacgcauucgcaauggaaagaaaugcuggaucugguauuaucauuucagauacaccaguccacgauugcaauacaacuugucaaacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccggcuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35723 - RNA, 1701 nt, Artificial Sequence
  hemagglutinin__InfluenzaA__ADJ84772
augaaaacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggaaaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaacuucaaauacccagcauugaacgugacuaugccaaacaaugaacaauuugacaaauuguacauuugggggguucaccacccggguacggacaaagaccaaaucuuccuguaugcucaagcaucaggaagaaucacagucucuaccaaaagaagccaacaaacugcaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuucagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35724 - RNA, 1701 nt, Artificial Sequence
  hemagglutinin__InfluenzaA__ADJ88782
augaagacuaucauugcuuugagcuacaugcuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacggagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauuaaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugggggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 35725 - RNA, 1701 nt, Artificial Sequence
  hemagglutinin__InfluenzaA__ADK21733
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuaguacugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35726 - RNA, 1701 nt, Artificial Sequence
  hemagglutinin__InfluenzaA__ADK21743
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacaucgcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagaucagcaacuccuacauuaaugauaaagggaaagaaguucucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35727 - RNA, 1701 nt, Artificial Sequence
  hemagglutinin__InfluenzaA__ADK21753
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaagagcuaagagagcaauugagcucagugucaucauuugaaagguuugagauauuccccaagacaaguucauggcccaaucaugacucuaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaggaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35728 - RNA, 1701 nt, Artificial Sequence
  hemagglutinin__InfluenzaA__ADK21763
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaaaauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugugauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35729 - RNA, 1701 nt, Artificial Sequence; identical to SEQ ID NO: 34337
  hemagglutinin__InfluenzaA__ADK21773

SEQ ID NO: 35730 - RNA, 1701 nt, Artificial Sequence
  hemagglutinin__InfluenzaA__ADK21783
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuggugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35731 - RNA, 1701 nt, Artificial Sequence
  hemagglutinin__InfluenzaA__ADK21813
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaaaggugcuauaaacaccagccucccauuucagaauauacauccgaucacaauuggaaaauguccaaaauauguaaaaagcacaaaauugagacuggccacaggauugcggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35732 - RNA, 1701 nt, Artificial Sequence
  hemagglutinin__InfluenzaA__ADK21823
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcggcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgagcuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35733 - RNA, 1701 nt, Artificial Sequence
  hemagglutinin__InfluenzaA__ADK21833
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguucgcgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaauaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35734 - RNA, 1701 nt, Artificial Sequence
  hemagglutinin__InfluenzaA__ADK21843
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaaucauacauuaaugauaaagggaaagaaguccucgugcuauggggcauucaccauccaucuacuagugcugaccaacagagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35735 - RNA, 1701 nt, Artificial Sequence
  hemagglutinin__InfluenzaA__ADK21853
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccacuuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35736 - RNA, 1701 nt, Artificial Sequence; identical to SEQ ID NO: 35643
  hemagglutinin__InfluenzaA__ADK21863

SEQ ID NO: 35737 - RNA, 1701 nt, Artificial Sequence
  hemagglutinin__InfluenzaA__ADK21873
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaaggaaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35738 - RNA, 1701 nt, Artificial Sequence
  hemagglutinin__InfluenzaA__ADK21883
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgaaauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35739 - RNA, 1701 nt, Artificial Sequence; identical to SEQ ID NO: 33206
  hemagglutinin__InfluenzaA__ADK21893

SEQ ID NO: 35740 - RNA, 1701 nt, Artificial Sequence; identical to SEQ ID NO: 35358
  hemagglutinin__InfluenzaA__ADK21903

SEQ ID NO: 35741 - RNA, 1701 nt, Artificial Sequence; identical to SEQ ID NO: 35336
  hemagglutinin__InfluenzaA__ADK21913

SEQ ID NO: 35742 - RNA, 1701 nt, Artificial Sequence
  hemagglutinin__InfluenzaA__ADK21923
augaaggcaauacuaguaguucugcuauauacauuugcaacagcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaggcaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguacauugguacugguagucucccugggggcaaucaguuucuggaugugcucuaaugggucucuacaguguagaauauguauuuaa

SEQ ID NO: 35743 - RNA, 1701 nt, Artificial Sequence
  hemagglutinin__InfluenzaA__ADK21933
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguugaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccuaaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagguacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauccaaucuagaggccuauuuggggccauugccggcuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35744 - RNA, 1701 nt, Artificial Sequence
  hemagglutinin__InfluenzaA__ADK21943
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuccuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagagguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggauguguucuaaugggucucuacaguguagaauauguauuuaa

SEQ ID NO: 35745 - RNA, 1701 nt, Artificial Sequence
  hemagglutinin__InfluenzaA__ADK21953
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgaucaugaggagcuaagagagcaauugagcucagugucaucauuugaaagguuugagauauuccccaagacaaguucauggcccaaucaugacucgaacaaagguguaacggcagcaugcccucaugcuggagcaaaaagcuucuacaaaaauuuaauauggcuaguuaaaaaaggaaauucauacccaaagcucagcaaauccuacauuaaugauaaagggaaagaaguccucgugcuaugggccauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35746 - RNA, 1701 nt, Artificial Sequence; identical to SEQ ID NO: 35360
  hemagglutinin__InfluenzaA__ADK32390

SEQ ID NO: 35747 - RNA, 1701 nt, Artificial Sequence
  hemagglutinin__InfluenzaA__ADK32400
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugccagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaagcaaaauuaaacagagaaaaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35748 - RNA, 1701 nt, Artificial Sequence
  hemagglutinin__InfluenzaA__ADK32420
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggggcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauucgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugaacaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35749 - RNA, 1701 nt, Artificial Sequence; identical to SEQ ID NO: 35118
  hemagglutinin__InfluenzaA__ADK32430

SEQ ID NO: 35750 - RNA, 1701 nt, Artificial Sequence
  hemagglutinin__InfluenzaA__ADK32440
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgggauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35751 - RNA, 1701 nt, Artificial Sequence
  hemagglutinin__InfluenzaA__ADK32450
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauuuggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggucaucaagauacagcaagaaguucaagccggaaauagcaauuagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagaugcaccaguccaugauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccagcuaaaaaacaaugccaaggaaguuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugccgccaguucauugguacugguagucucccugggggcaaucaguuucuggaugugcucuaaugggucucuacaguguagaauauguauuuaa

SEQ ID NO: 35752 - RNA, 1701 nt, Artificial Sequence
  hemagglutinin__InfluenzaA__ADK32460
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35753 - RNA, 1701 nt, Artificial Sequence; identical to SEQ ID NO: 34337
  hemagglutinin__InfluenzaA__ADK32470

SEQ ID NO: 35754 - RNA, 1701 nt, Artificial Sequence
  hemagglutinin__InfluenzaA__ADK32480
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccagcccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35755 - RNA, 1701 nt, Artificial Sequence
  hemagglutinin__InfluenzaA__ADK32490
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaaggugugacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauuugaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucgacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35756 - RNA, 1701 nt, Artificial Sequence
  hemagglutinin__InfluenzaA__ADK32502
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucuaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuugugggaacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35757 - RNA, 1701 nt, Artificial Sequence
  hemagglutinin__InfluenzaA__ADK32637
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucguguuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuguaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35758 - RNA, 1701 nt, Artificial Sequence; identical to SEQ ID NO: 34777
  hemagglutinin__InfluenzaA__ADK32647

SEQ ID NO: 35759 - RNA, 1701 nt, Artificial Sequence
  hemagglutinin__InfluenzaA__ADK32657
augaaggcaauacuaguaguucugcuauauacauuugcaaccgcaaaugcagacacauuauguauagguuaucaugcgaacaauucaacagacacuguagacacaguacuagaaaagaacguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaauggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaaaguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35760 - RNA, 1701 nt, Artificial Sequence
  hemagglutinin__InfluenzaA__ADK32677
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaagggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35761 - RNA, 1701 nt, Artificial Sequence
  hemagglutinin__InfluenzaA__ADK32687
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaaacuucuacaaaaauuuaauauggcuaguuaaaaaaggaaauucauacccaaagcucagcaaauccuacauaaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucuuugguacugguagucucccugggggcaaucaguuucuggaugugcucuaaugggucucuacaguguagaauauguauuuaa

SEQ ID NO: 35762 - RNA, 1701 nt, Artificial Sequence
  hemagglutinin__InfluenzaA__ADK32697
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35763 - RNA, 1701 nt, Artificial Sequence; identical to SEQ ID NO: 34795
  hemagglutinin__InfluenzaA__ADK32776

SEQ ID NO: 35764 - RNA, 1701 nt, Artificial Sequence; identical to SEQ ID NO: 34731
  hemagglutinin__InfluenzaA__ADK33621

SEQ ID NO: 35765 - RNA, 1701 nt, Artificial Sequence
  hemagglutinin__InfluenzaA__ADK33631
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagucaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucaauuaugaggagcuaagagagcaauugagcucagugucaucauuugaaagguuugagauauuccccaagacaaguucauggcccaaucaugacucgaacaaagguguaacggcugcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucaucucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuugaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35766 - RNA, 1701 nt, Artificial Sequence; identical to SEQ ID NO: 35118
  hemagglutinin__InfluenzaA__ADK33641

SEQ ID NO: 35767 - RNA, 1701 nt, Artificial Sequence
  hemagglutinin__InfluenzaA__ADK33651
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaagagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuaguagucucccugggggcaaucaguuucuggaugugcucuaaugggucacuacaguguagaauauguauuuaa

SEQ ID NO: 35768 - RNA, 1701 nt, Artificial Sequence; identical to SEQ ID NO: 35767
  hemagglutinin__InfluenzaA__ADK33661

SEQ ID NO: 35769 - RNA, 1701 nt, Artificial Sequence
  hemagglutinin__InfluenzaA__ADK33671
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccuuaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35770 - RNA, 1701 nt, Artificial Sequence
  hemagglutinin__InfluenzaA__ADK33681
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuagucaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaaauuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35771 - RNA, 1701 nt, Artificial Sequence
  hemagglutinin__InfluenzaA__ADK33691
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacaucaaugauaaagggaaagaaguccucgugcuauggggcauucaccauccaucuacuagugcugaccaacaaagucucuaucagaaugcagauucauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccgagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35772 - RNA, 1701 nt, Artificial Sequence
  hemagglutinin__InfluenzaA__ADK33701
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugcagaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggguuuaccagauuuuggcgaucuauucaacugucgccaguucauugguacugguagucucccugggggcaaucaguuucuggaugugcucuaaugggucucuacaguguagaauauguauuuaa

SEQ ID NO: 35773 - RNA, 1701 nt, Artificial Sequence
  hemagglutinin__InfluenzaA__ADK33711
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaauccuagugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaauaucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaacucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35774 - RNA, 1701 nt, Artificial Sequence
  hemagglutinin__InfluenzaA__ADK33721
augaaggcaauacuaguaguucugcuauauacauuuguaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35775 - RNA, 1701 nt, Artificial Sequence
  hemagglutinin__InfluenzaA__ADK33731
augaaggcaacacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaauuaugcaaacuaagagggguagccccauugcauuuggguaaauguaacauugcuggcuggauccugggaaauccagagugugaaucacucuccacagcaagcucaugguccuacauuguggaaacaucuaguucaggcaauggaacguguuacccaggagauuucaucgauuaugaagagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaacucauacccaaagcucagcaaauccuacauuaaugauaaagggaaagaaguccucgugcuauggggcauucaccauccaucuacuagugcugaccaacaaagucucuaucagaaugcagaugcauaugcuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuauugguaccgagauaugcauucgcaauggaaagaaaugcuggaucugguauuaucauuucagauacaccaguccacgauugcaauacaacuugucagacacccaagggugcuauaaacaccagccucccauuucagaacauacauccgaucacaauuggaaaauguccaaaauauguaaaaagcacaaaauugagacuggccacaggauugaggaacgucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccgaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35776 - RNA, 1701 nt, Artificial Sequence
  hemagglutinin__InfluenzaA__ADK33741
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35777 - RNA, 1701 nt, Artificial Sequence
  hemagglutinin__InfluenzaA__ADK33751
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35778 - RNA, 1701 nt, Artificial Sequence
  hemagglutinin__InfluenzaA__ADK33761
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuacuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagccuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35779 - RNA, 1701 nt, Artificial Sequence
  hemagglutinin__InfluenzaA__ADK33771
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguagggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacaagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35780 - RNA, 1701 nt, Artificial Sequence; identical to SEQ ID NO: 34875
  hemagglutinin__InfluenzaA__ADK33781

SEQ ID NO: 35781 - RNA, 1701 nt, Artificial Sequence; identical to SEQ ID NO: 34281
  hemagglutinin__InfluenzaA__ADK33791

SEQ ID NO: 35782 - RNA, 1701 nt, Artificial Sequence; identical to SEQ ID NO: 35772
  hemagglutinin__InfluenzaA__ADK33801

SEQ ID NO: 35783 - RNA, 1701 nt, Artificial Sequence
  hemagglutinin__InfluenzaA__ADK33811
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucaacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggauaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35784 - RNA, 1701 nt, Artificial Sequence
  hemagglutinin__InfluenzaA__ADK33821
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucacaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaagguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaaccgucgccaguucauugguacuggcagucucccugggggcaaucaguuucuggaugugcucuaaugggucucuacaguguagaauauguauuuaa

SEQ ID NO: 35785 - RNA, 1701 nt, Artificial Sequence
  hemagglutinin__InfluenzaA__ADK33831
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaauacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35786 - RNA, 1701 nt, Artificial Sequence
  hemagglutinin__InfluenzaA__ADK33841
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggaauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagcaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35787 - RNA, 1701 nt, Artificial Sequence; identical to SEQ ID NO: 35340
  hemagglutinin__InfluenzaA__ADK33851

SEQ ID NO: 35788 - RNA, 1701 nt, Artificial Sequence; identical to SEQ ID NO: 35326
  hemagglutinin__InfluenzaA__ADK33861

SEQ ID NO: 35789 - RNA, 1701 nt, Artificial Sequence
  hemagglutinin__InfluenzaA__ADK33871
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaacaagaagggagaaugaacuauuacuggacacuaguagagccgggagacaaaauaacauucgaagcaacuggaaaucuagugauaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacuguuagucucccugggggcaaucaguuucuggaugugcucuaaugggucucuacaguguagaauauguauuuaa

SEQ ID NO: 35790 - RNA, 1701 nt, Artificial Sequence
  hemagglutinin__InfluenzaA__ADK33881
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaacauucuagaagacaagcauaacgggaaacuaugcaaacuaagagggguagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaucugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuaccccaaauacucagaggaggcaaaauuaaacagagaagaaauagaugggguaaagcuggaaucaacaaagauuuaccagauuuuggcgaucuauucaacugucgccaguucauugguacugguagucucccugggggcaaucaguuucuggaugugcucuaaugggucucuacaguguagaauauguauuuaa

SEQ ID NO: 35791 - RNA, 1701 nt, Artificial Sequence
  hemagglutinin__InfluenzaA__ADK33891
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccgucuauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaaaccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa

SEQ ID NO: 35792 - RNA, 1701 nt, Artificial Sequence
  hemagglutinin__InfluenzaA__ADK33901
augaaggcaauacuaguaguucugcuauauacauuugcaaccgcaaaugcagacacauuauguauagguuaucaugcgaacaauucaacagacacuguagacacaguacuagaaaagaauguaacaguaacacacucuguuaaccuucuagaagacaagcauaacgggaaacuaugcaaacuaagagggauagccccauugcauuuggguaaauguaacauugcuggcuggauccugggaaauccagagugugaaucacucuccacagcaagcucaugguccuacauuguggaaacaucuaguucagacaauggaacguguuacccaggagauuucaucgauuaugaggagcuaagagagcaauugagcucagugucaucauuugaaagguuugagauauuccccaagacaaguucauggcccaaucaugacucgaacaaagguguaacggcagcauguccucaugcuggagcaaaaagcuucuacaaaaauuuaauauggcuaguuaaaaaaggaaauucauacccaaagcucagcaaauccuacauuaaugauaaagggaaagaaguccucgugcuauggggcauucaccauccaucuacuagugcugaccaacaaagucucuaucagaaugcagaugcauauguuuuuguggggacaucaagauacagcaagaaguucaagccggaaauagcaauaagacccaaagugagggaucaagaagggagaaugaacuauuacuggacacuaguagagccgggagacaaaauaacauucgaagcaacuggaaaucuagugguaccgagauaugcauucgcaauggaaagaaaugcuggaucugguauuaucauuucagauacaccaguccacgauugcaauacaacuugucagacacccaagggugcuauaaacaccagccucccauuucagaauauacauccgaucacaauuggaaaauguccaaaauauguaaaaagcacaaaauugagacuggccacaggauugaggaaugucccguccauucaaucuagaggccuauuuggggccauugccgguuucauugaagggggguggacagggaugguagauggaugguacgguuaucaccaucaaaaugagcaggggucaggauaugcagccgaccugaagagcacacagaaugccauugacgagauuacuaacaaaguaaauucuguuauugaaaagaugaauacacaguucacagcaguagguaaagaguucaaccaccuggaaaaaagaauagagaauuuaaauaaaaaaguugaugaugguuuccuggacauuuggacuuacaaugccgaacuguugguucuauuggaaaaugaaagaacuuuggacuaccacgauucaaaugugaagaacuuauaugaaaagguaagaagccaguuaaaaaacaaugccaaggaaauuggaaacggcugcuuugaauuuuaccacaaaugcgauaacacgugcauggaaagugucaaaaaugggacuuaugacuacccaaaauacucagaggaagcaaaauuaaacagagaagaaauagaugggguaaagcuggaaucaacaaggauuuaccagauuuuggcgaucuauucaacugucgccaguucauugguacugguagucucccugggggcaaucaguuucuggaugugcucuaaugggucucuacaguguagaauauguauuuaa
